(12) United States Patent
Feinstein et al.

(10) Patent No.: US 8,785,408 B2
(45) Date of Patent: Jul. 22, 2014

(54) COMPOSITIONS AND METHODS FOR REDUCING OR PROTECTING AGAINST DELAYED GRAFT FUNCTION (DGF)

(75) Inventors: Elena Feinstein, Rehovot (IL); Shai Erlich, Belmont, CA (US)

(73) Assignee: Quark Pharmaceuticals, Inc., Fremont, CA (US)

( * ) Notice: Subject to any disclaimer, the term of this patent is extended or adjusted under 35 U.S.C. 154(b) by 275 days.

(21) Appl. No.: 12/452,321

(22) PCT Filed: Jun. 26, 2008

(86) PCT No.: PCT/IL2008/000874
§ 371 (c)(1), (2), (4) Date: May 6, 2010

(87) PCT Pub. No.: WO2009/001359
PCT Pub. Date: Dec. 31, 2008

(65) Prior Publication Data
US 2010/0222409 A1 Sep. 2, 2010

Related U.S. Application Data

(60) Provisional application No. 60/964,325, filed on Aug. 10, 2007, provisional application No. 60/937,318, filed on Jun. 27, 2007.

(51) Int. Cl.
*A61K 48/00* (2006.01)
*C07H 21/02* (2006.01)
*C07H 21/04* (2006.01)

(52) U.S. Cl.
USPC .......................... 514/44; 536/23.1; 536/24.5

(58) Field of Classification Search
None
See application file for complete search history.

(56) References Cited

U.S. PATENT DOCUMENTS

| | | | |
|---|---|---|---|
| 4,497,817 A | 2/1985 | Murase et al. | |
| 5,849,774 A | 12/1998 | Jackson et al. | |
| 5,898,031 A | 4/1999 | Crooke | |
| 6,107,094 A | 8/2000 | Crooke | |
| 6,372,249 B1 | 4/2002 | Smith et al. | |
| 6,506,559 B1 | 1/2003 | Fire et al. | |
| 6,593,353 B1 | 7/2003 | Gudkov et al. | |
| 6,982,277 B2 | 1/2006 | Gudkov et al. | |
| 7,008,956 B2 | 3/2006 | Gudkov et al. | |
| 7,012,087 B2 | 3/2006 | Gudkov et al. | |
| 7,056,704 B2 | 6/2006 | Tuschl | |
| 7,078,196 B2 | 7/2006 | Tuschl | |
| 7,432,249 B2 | 10/2008 | Crooke | |
| 7,432,250 B2 | 10/2008 | Crooke | |
| 7,452,987 B2 | 11/2008 | Giese | |
| 7,459,547 B2 | 12/2008 | Zamore | |
| 7,629,321 B2 | 12/2009 | Crooke | |
| 7,781,575 B2 | 8/2010 | Khvorova et al. | |
| 7,825,099 B2 | 11/2010 | Feinstein | |
| 7,842,674 B2 | 11/2010 | Feinstein et al. | |
| 7,893,245 B2 | 2/2011 | Giese | |
| 7,910,566 B2 | 3/2011 | Feinstein | |
| 8,148,342 B2 | 4/2012 | Feinstein et al. | |
| 2002/0006941 A1 | 1/2002 | Gudkov et al. | |
| 2002/0019425 A1 | 2/2002 | Gudkov et al. | |
| 2003/0144331 A1 | 7/2003 | Gudkov et al. | |
| 2003/0176318 A1 | 9/2003 | Gudkov et al. | |
| 2004/0014956 A1 | 1/2004 | Woolf et al. | |
| 2004/0180351 A1 | 9/2004 | Giese et al. | |
| 2004/0209832 A1 | 10/2004 | McSwiggen et al. | |
| 2005/0080246 A1 | 4/2005 | Allerson et al. | |
| 2005/0153337 A1 | 7/2005 | Manoharan | |
| 2005/0222224 A1 | 10/2005 | Gudkov et al. | |
| 2005/0255487 A1 | 11/2005 | Khvorova et al. | |
| 2005/0260620 A1 | 11/2005 | Christiano et al. | |
| 2005/0261191 A1 | 11/2005 | Barasch et al. | |
| 2006/0024278 A1 | 2/2006 | Chen | |
| 2006/0069056 A1 | 3/2006 | Feinstein et al. | |
| 2006/0217329 A1 | 9/2006 | Feinstein | |
| 2007/0031844 A1 | 2/2007 | Khvorova et al. | |
| 2007/0185047 A1 | 8/2007 | Bhat et al. | |
| 2007/0212330 A1 | 9/2007 | Vlodavsky et al. | |
| 2008/0064650 A1 | 3/2008 | Feinstein et al. | |
| 2008/0084471 A1 | 4/2008 | Feinstein et al. | |
| 2008/0108583 A1 | 5/2008 | Feinstein et al. | |
| 2008/0161426 A1 | 7/2008 | Gudkov et al. | |
| 2008/0287382 A1 | 11/2008 | Feinstein et al. | |
| 2009/0082291 A1 | 3/2009 | Feinstein et al. | |
| 2009/0105173 A1 | 4/2009 | Feinstein | |
| 2010/0029746 A1 | 2/2010 | Feinstein | |
| 2010/0048425 A1 | 2/2010 | Khvorova et al. | |

FOREIGN PATENT DOCUMENTS

| | | |
|---|---|---|
| EP | 0430334 | 6/1991 |
| EP | 2284266 | 2/2011 |

(Continued)

OTHER PUBLICATIONS

Chiu et al., siRNA Function in RNAi: A Chemical modification analysis, RNA, (2003), 9:1034-1048.

(Continued)

*Primary Examiner* — Amy Bowman
(74) *Attorney, Agent, or Firm* — John P. White; Cooper & Dunham LLP

(57) ABSTRACT

The invention relates to one or more inhibitors, in particular siRNA compounds, which down-regulate the expression of a pro-apoptotic gene selected from the group consisting of TP53; HTRA2; KEAP1; SHC1-SHC, ZNHIT1, LGALS3 and HI95. The invention also relates to a pharmaceutical composition comprising the compound, and a pharmaceutically acceptable carrier. The present invention further provides methods of treating a subject afflicted with a disease or a condition associated with those genes, comprising administering to the subject a pharmaceutical composition in a therapeutically effective dose so as to thereby treat the subject.

20 Claims, No Drawings

(56) References Cited

FOREIGN PATENT DOCUMENTS

| | | |
|---|---|---|
| WO | WO 99/55910 | 11/1999 |
| WO | WO 00/24885 | 5/2000 |
| WO | WO 00/44895 | 8/2000 |
| WO | WO 00/44914 | 8/2000 |
| WO | WO 01/36646 | 5/2001 |
| WO | WO 01/68836 | 9/2001 |
| WO | WO 01/75164 | 10/2001 |
| WO | WO 02/44321 | 6/2002 |
| WO | WO 02/055693 | 7/2002 |
| WO | WO 02/059300 | 8/2002 |
| WO | WO 03/062394 | 7/2003 |
| WO | WO 03/064625 | 8/2003 |
| WO | WO 03/064626 | 8/2003 |
| WO | WO 03/070918 | 8/2003 |
| WO | WO 03/074654 | 9/2003 |
| WO | WO 2004/015107 | 2/2004 |
| WO | WO 2004/031237 | 4/2004 |
| WO | WO 2004/041889 | 5/2004 |
| WO | WO 2004/044136 | 5/2004 |
| WO | WO 2004/045543 | 6/2004 |
| WO | WO 2004/111191 | 12/2004 |
| WO | WO 2005/062937 | 7/2005 |
| WO | WO 2005/119251 | 12/2005 |
| WO | WO 2006/006948 | 1/2006 |
| WO | WO 2006/035434 | 4/2006 |
| WO | WO 2007/087451 | 8/2007 |
| WO | WO 2007/137129 | 11/2007 |
| WO | WO 2009/001359 | 12/2008 |
| WO | WO 2009/023025 | 2/2009 |
| WO | WO 2009/147684 | 12/2009 |

OTHER PUBLICATIONS

Hall et al., RNA interference using boranaphosphate siRNAs: structure-activity relationships, nucleic acids research, (2004), vol. 32(20):5991-6000.

Molitoris, BA (2003) "Transitioning to Therapy in Ischemic Acute Renal Failure." J. Am. Soc. Nephrol. 14: 265-267.

Scherer and Rossi (2004) Therapeutic Applications of RNA Interferences: Recent Advances in siRNA Design. Advances in Genetics 22:1-21.

Notice of Allowance and Allowed Claims in U.S. Appl. No. 12/586,271 (US 2010/0048425).

Oct. 26, 2009 Response to Second Written Opinion issued by the Australian Patent Office on May 26, 2009 in connection with Singapore Application No. 200702035-7.

Jan. 27, 2010 Exam Report and decision of grant in connection with Singapore Application No. 200702035-7.

Office Action issued by the Russian Patent Office on Jun. 2, 2010 in connection with Russian Patent Application No. 2007/116168.

Decision of Grant issued by the Russian Patent Office on Apr. 4, 2011 in connection with Russian Patent Application No. 2007/116168.

Notice of Allowance mailed on Jul. 22, 2010 in connection with Elena Feinstein et al., U.S. Appl. No. 11/827,199, filed Jul. 10, 2007.

First Office Action issued Mar. 29, 2010 in connection with Chinese Patent Application No. 200580032715.4 filed Sep. 27, 2005.

Aug. 12, 2010 Response and Amendment to First Office Action issued Mar. 29, 2010 in connection with Chinese Patent Application No. 200580032715.4 filed Sep. 27, 2005.

Amarzguioui et al., (2003), Nucleic Acids Research, 31(2):589-95, "Tolerance for Mutations and Chemical Modifications in a siRNA."

Barik, (2005) Mol. Med 2005, 83:764-773, "Silence of the transcripts; RNA Interference in Medicine".

Bartel et al., (2004), Cell, Jan. 23, 116(2):281-297, "MicroRNAs: Genomics, Review Biogenesis, Mechanism, and Function".

Bernstein et al., (2001), Nature, vol. 409:363-366, "Role for a Bidentate Ribonuclease in the Initiation Step of RNA Interference".

Bertrand et al (2002), "Comparison of antisense oligonucleotides and siRNAs in cell culture and in vivo", Biochemical and Biophysical Research Communications, 296:1000-1004.

Bitko et al., (2004), Nature Med., 11(1):50-55, "Inhibition of Respiratory Viruses by Nasally Administered siRNA".

Botchkarev et al., (2000), Cancer Research, 60:5002-5006 "p53 is Essential for Chemotherapy-Induced Hair Loss".

Brummelkamp et al., (2002), Science, vol. 296:550-553, "A System for Stable Expression of Short Interfering RNAs in Mammalian Cells".

Caplen et al., (2001), Proc Natl Acad Sci, 98(17):9742-9747, "Specific Inhibition of Gene Expression by Small Double-Stranded RNAs in Invertebrate Vertebrate Systems".

Chakraborty, (2007), Current Drug Targets, vol. 8(3):469-82, "Potentiality of Small Interfering RNAs (siRNA) as Recent Therapeutic Targets for Gene-Silencing".

Chalk et al., (2004), Biochem. Biophys. Res. Commun. Jun. 18; 319(1):264-274, "Improved and Automated Prediction of Effective siRNA."

Cheng, QL et al. (2000), "Effects of ICAM-1 antisense oligonucleotide on the tubulointerstitium in mice with unilateral ureteral obstruction", Kidney International, vol. 57:183-190.

Chernov et al., (1997), Oncogene 14:2503-2510, "The p53 Activation and Apoptosis Induced by DNA Damage are . . . ".

Cotsarelis et al., (2001), Trends Mol. Med. 7(7):293-301, "Towards a Molecular Understanding of Hair Loss and . . . ".

Czauderna et al., (2003), Nucleic Acids Research, 31(11):2705-16, "Structural Variations and Stabilising Modifications of Synthetic siRNAs in Mammalian Cells."

Dragon Duska et al. "Inhibition of intracellular adhesion molecule-1 with antisense deoxynucleotides prolongs renal isograft survival in the rat", Kidney International, Nature Publishing Group. vol. 54, No. 6, Dec. 1, 1998, pp. 2113-2122.

Elbashir et al., (2001), Genes Dev., 15 pp. 188-200, "RNA Interference is Mediated by 21- and 22-nucleotide RNAs".

Elbashir et al., (2001),Nature 411:494-498, "Duplexes of 21-nucleotide Mediated RNA Interference in Cultured Mammalian Cells".

Elbashir et al., (2001), Embo Journal, 20(23):6877-88, "Functional Anatomy of siRNAs for Mediating Efficient RNAi in *Drosophila melanogaster* Embryo Lysate."

Fire et al., (1998), Nature, vol. 391:806-811, "Potent and Specific Genetic Interference by Double-Stranded RNA in *Caenorhabditis elegans*."

Gottlieb TM et al., (1996) Biochim Biophys Acta 1287:77-102 "P53 in growth control and neoplasia."

Healy D et al. "Heat shock-induced protection of renal proximal tubular epithelial cells from cold storage and rewarming injury" Journal of the American Society of Nephrology. vol. 17, No. 3, Mar. 2006, pp. 805-812.

Hochegger Kathrin et al. "p21 and mTERT are novel markers for determining different ischemic time periods in renal ischemia-reperfusion injury", American Journal of Physiology. Renal Physiology Feb. 2007. pp. F762-F768.

Holen et al., (2002), Positional effects of short interfering RNAs targeting the human coagulation trigger Tissue Factor, Nucleic Acids Research, 30 (8) :1757-1766.

Kelly et al: "P53mediates the apoptotic response to GTP depletion after renal ischemia-reperfusion: Protective role of a p53 inhibitor", Journal of the American Society of Nephrology 2003 vol. 14, pp. 128-138.

Komarov PG et al., (1999) Science 285:1733-1737 "A chemical inhibitor of p53 that protects Mice from the Side Effects of Cancer Therapy".

Komarova EA et al., (1997) EMBO J. 16(6):1391-1400 "Transgenic mice with p53-responsive *lacZ*: p53 activity varies dramatically during normal development and determines radiation and drug sensitivity in vivo".

Lee et al., (2003), Nature, vol. 425:415-419, "The Nuclear RNase III Drosha Initiates mircoRNA Processing."

Levenkova et al., (2004), Bioinformatics 20(3):430-432, "Gene specific siRNA selector."

Mahato et al (2005) "Modulation of gene expression by antisense and antigene oligodeoxynucleotides and small interfering RNA", Expert Opinion on Drug Delivery, 2 (1):3-28.

Matta et al Cancer Biology & Therapy 2003, vol. 2, pp. 206- 210.

(56) References Cited

OTHER PUBLICATIONS

McManus et al., (2002), Nature Reviews Genetics, vol. 3:737-747, "Gene Silencing in Mammals by Small Interfering RNAs".
Molitoris, BA et al. (2009) "siRNA Targeted to P53 Attenuates Ischemic and Cisplatin-Induced Acute Kidney Injury". JASN Express, 20:1754:1764.
Perico Norberto et al. "Delayed graft function in kidney transplantation", Lancet (North American Edition), vol. 364, No. 9447, Nov. 13, 2004, pp. 1814-1827.
Prakash et al., (2005), "Positional effect of chemical modifications on short interference RNA activity in mammalian cells.", J. Med Chem. :48(13), pp. 4247-4253.
Scherer et al., (2003), Nat. Biotechnol., 21(12):1457-1465, "Approaches for the Sequence-Specific Knockdown of mRNA."
Schomber et al. (2004) Blood, (2004)103(12):4511-4513. "Gene silencing by lentivirus-mediated delivery of siRNA in human CD4+ cells."
Seidman M. et al., (2003). "Pharamcologic manipulation of the labyrinth with novel and traditional agents delivered to the inner ear", Ear, Nose & Throat Journal, 82(4):276-280, 282-283, 287-288, 290, 292, 294, 296, 298, 300.
Sioud et al., (2004), Methods in Molec Biol., 252:457-468, "Potential Design Rules and Enzymatic Synthesis of siRNAs".
Steele RJC et al., (1998) Br. J. Surg. 85:1460-1467 "The p53 tumour suppressor gene."
Supavekin, S. et al., (2003) "Differential gene expression following early renal ischemia/reperfusion". Kidney Int. 63:1714-1724.
Tekippe M et al., (2003) Exp. Hematol. 31:521-527 "Expansion of hematopoietic stem cell phenotype and activity in Trp53-null mice."
Tolentino et al., (2004), Journal of Retinal and Vitreous Diseases, Feb., 24(1):132-138, "Intravitreal Injection of Vascular Endothelial Growth Factor Small Interfering RNA Inhitits . . . ".
Ui-Tei et al., (2004), Nucleic Acids Research, vol. 32(3):936-48, "Guidelines for the Selection of Highly Effective siRNA Sequences for Mammalian and Chick RNA Interference . . . ".
Van De Water, Femke M. et al.(2006), "Intravenously administered short interfering RNA accumulates in the kidney and selectively suppresses gene function in renal proximal tubules", Drug Metabolism and Disposition vol. 34: 1393-1397.
Wang J et al. (2003). The J. of Neuroscience, 23(24):8596-8607. "A peptide inhibitor of c-Jun N-Terminal Kinase Protects against . . . ".
Wlodarski P et al., (1998) Blood 91(8):2998-3006 Role of p53 in hematopoietic recovery after cytotoxic treatment.
Zhang, M. et al., (2003). "Pifithrin-alpha Suppresses p53 and Protects Cochlear and Vestibular Hair Cells From Cisplatin-Induced Apoptosis," Neuroscience, 120:191-205.
Zhang et al., (2004) Current Pharmaceutical Biotechnology, 5:1-7,"Targeted Gene Silencing by Small RNA-Based Knock-Down Technology".
Office Action issued on Mar. 23, 2001 in connection with U.S. Appl. No. 09/493,527, filed Jan. 28, 2000.
Office Action issued on Jul. 2, 2001 in connection with U.S. Appl. No. 09/493,527, filed Jan. 28, 2000.
Office Action issued on Jun. 6, 2002 in connection with U.S. Appl. No. 09/493,527, filed Jan. 28, 2000.
Office Action issued on Feb. 12, 2003 in connection with U.S. Appl. No. 09/880,417, filed Jun. 13, 2001.
Office Action issued on Oct. 9, 2003 in connection with U.S. Appl. No. 09/880,417, filed Jun. 13, 2001.
Office Action issued on Jul. 9, 2004 in connection with U.S. Appl. No. 09/880,417, filed Jun. 13, 2001.
Office Action issued on Dec. 28, 2001 in connection with U.S. Appl. No. 09/947,757, filed Sep. 6, 2001.
Office Action issued on Mar. 26, 2003 in connection with U.S. Appl. No. 09/947,757, filed Sep. 6, 2001.
Office Action issued on Jul. 15, 2003 in connection with U.S. Appl. No. 09/947,757, filed Sep. 6, 2001.
Office Action issued on Nov. 19, 2003 in connection with U.S. Appl. No. 09/947,757, filed Sep. 6, 2001.
Office Action issued on Jul. 13, 2004 in connection with U.S. Appl. No. 09/947,757, filed Sep. 6, 2001.
Office Action issued on Nov. 26, 2004 in connection with U.S. Appl. No. 09/947,757, filed Sep. 6, 2001.
Office Action issued on Apr. 6, 2004 in connection with U.S. Appl. No. 10/350,560, filed Jan. 24, 2003.
Office Action issued on Jan. 3, 2005 in connection with U.S. Appl. No. 10/350,560, filed Jan. 24, 2003.
Office Action issued on Sep. 9, 2004 in connection with U.S. Appl. No. 10/352,597, filed Jan. 28, 2003.
Office Action issued on Apr. 21, 2005 in connection with U.S. Appl. No. 10/352,597, filed Jan. 28, 2003.
Office Action issued on Oct. 30, 2007 in connection with U.S. Appl. No. 11/136,231, filed May 24, 2005.
Office Action issued on Nov. 12, 2009 in connection with U.S. Appl. No. 12/022,317, filed Jan. 30, 2008.
International Search Report issued by the International Searching Authority (ISA/US) on Aug. 23, 2001 in connection with International Application No. PCT/US00/02104.
International Preliminary Examination Report by WIPO on May 15, 2001 in connection with International Application No. PCT/US00/02104.
Communication under Rule 112 EPC issued by the European Patent Office on Dec. 16, 2003 in connection with European Patent Application No. 00914455.1.
Communication pursuant to Article 96(2) EPC issued by the European Patent Office on Feb. 12, 2004 in connection with European Patent Application No. 00914455.1.
Communication pursuant to Article 96(2) EPC issued by the European Patent Office on Aug. 19, 2004 in connection with European Patent Application No. 00914455.1.
Communication pursuant to Article 96(2) EPC issued by the European Patent Office on May 13, 2005 in connection with European Patent Application No. 00914455.1.
Result of consultation issued by the European Patent Office on Oct. 25, 2005 in connection with European Patent Application No. 00914455.1.
Communication pursuant to Article 96(2) EPC issued by the European Patent Office on Mar. 10, 2006 in connection with European Patent Application No. 00914455.1.
Communication pursuant to Article 96(2) EPC issued by the European Patent Office on Oct. 24, 2006 in connection with European Patent Application No. 00914455.1.
Communication under Rule 51(4) EPC issued by the European Patent Office on Apr. 5, 2007 in connection with European Patent Application No. 00914455.1.
Notice of opposition issued on Sep. 11, 2008 in connection with European Patent Application No. 00914455.1.
Reply of the patent proprietor to the notice of opposition on Jun. 24, 2009, in connection with European Patent Application No. 00914455.1.
Written submission in preparation to oral proceedings issued on Oct. 8, 2010 in connection with European Patent Application No. 00914455.1.
Written submission in preparation to oral proceedings issued on Oct. 16, 2010 in connection with European Patent Application No. 00914455.1.
Written submission in preparation to oral proceedings issued on Nov. 30, 2010 in connection with European Patent No. 00914455.1.
Written submission in preparation to oral proceedings issued on Dec. 1, 2010 in connection with European Patent Application No. 00914455.1.
Decision of the Opposition Division issued by the European Patent Office on Feb. 10, 2011 in connection with European Patent Application No. 00914455.1.
Grounds for the decision (Annex)—opposition issued by the European Patent Office on Feb. 17, 2011 in connection with European Patent Application No. 00914455.1.
Office Action issued on Nov. 9, 2006 in connection with U.S. Appl. No. 11/237,598, filed Sep. 27, 2005.
Response to Office Action issued on Nov. 9, 2006 in connection with U.S. Appl. No. 11/237,598, filed Dec. 8, 2006.

(56) References Cited

OTHER PUBLICATIONS

Non-final Office Action issued on Mar. 14, 2007 in connection with U.S. Appl. No. 11/237,598, filed Sep. 27, 2005.
Response to Office Action issued on Mar. 14, 2007 in connection with U.S. Appl. No. 11/237,598, filed Sep. 14, 2007.
Final Office Action issued on Dec. 3, 2007 in connection with U.S. Appl. No. 11/237,598, filed Sep. 27, 2005.
Response to Final Office Action issued on Dec. 3, 2007 in connection with U.S. Appl. No. 11/237,598, filed May 5, 2008.
Advisory Action issued on Jun. 2, 2008 in connection with U.S. Appl. No. 11/237,598, filed Sep. 27, 2005.
Request for Continued Examination (RCE) filed on Jun. 3, 2008 in connection with U.S. Appl. No. 11/237,598, filed Sep. 27, 2005.
Supplemental Submission accompanying request for continued examination filed on Jul. 28, 2008.
Non-final Office Action issued on Oct. 28, 2008 in connection with U.S. Appl. No. 11/237,598, filed Sep. 27, 2005.
Response to Office Action issued Oct. 28, 2008 in connection with U.S. Appl. No. 11/237,598, filed Apr. 27, 2009.
Final Office Action issued on Aug. 19, 2009 in connection with U.S. Appl. No. 11/237,598, filed Sep. 27, 2005.
Notice of Appeal in connection with U.S. Appl. No. 11/237,598 filed Sep. 9, 2009.
Notice of Allowance mailed on Nov. 18, 2009 in connection with Elena Feinstein et al., U.S. Appl. No. 11/237,598, filed Sep. 27, 2005 and allowed claims.
Request for Continued Examination in connection with Elena Feinstein et al., U.S. Appl. No. 11/237,598, filed on Mar. 11, 2010.
Non-final Office Action issued on May 10, 2010, in connection with Elena Feinstein et al., U.S. Appl. No. 11/237,598, filed Sep. 27, 2005.
Response to Office Action issued on May 10, 2010 in connection with U.S. Appl. No. 11/237,598, filed Nov. 10, 2010.
Final Office Action issued on Feb. 15, 2011 in connection with U.S. Appl. No. 11/237,598, filed Sep. 27, 2005.
Pending claims in Elena Feinstein, et al., U.S. Appl. No. 11/237,598.
Non-Final Office Action issued on Sep. 23, 2009 in connection with U.S. Appl. No. 11/827,199, filed Jul. 10, 2007.
Response to Office Action issued on Sep. 23, 2009 in connection with U.S. Appl. No. 11/827, 199, filed Mar. 23, 2010.
Notice of Allowance mailed on Jul. 22, 2010 in connection with Elena Feinstein et al., U.S. Appl. No. 11/827,199, filed Jul. 10, 2007 and allowed claims.
Nov. 10, 2010 Issue Notification and issued claims in Elena Feinstein et al., U.S. Appl. No. 11/827,199, filed Jul. 10, 2007.
Pending claims in Elena Feinstein, et al., U.S. Appl. No. 12/008,578, filed Jan. 11, 2008.
Preliminary Amendment to the claims filed on Sep. 10, 2010 in connection with Elena Feinstein et al., U.S. Appl. No. 12/008,578, filed Jan. 11, 2008.
Non-final Official Action issued on Oct. 4, 2010, in connection with Elena Feinstein et al., U.S. Appl. No. 12/008,578, filed Jan. 11, 2008.
Response to Office Action issued on Oct. 4, 2010 in connection with U.S. Appl. No. 12/008,578, electronically filed on Dec. 3, 2010.
Supplemental Amendment submitted to supplement the Communication electronically filed on Dec. 3, 2010 in connection with U.S. Appl. No. 12/008,578, filed Dec. 28, 2010.
Non-final Official Action issued on Mar. 10, 2011, in connection with Elena Feinstein et al., U.S. Appl. No. 12/008,578, filed Jan. 11, 2008.
International Search Report issued by the International Searching Authority (ISA/US) on Dec. 3, 2007 in connection with International Application No. PCT/IL05/01035.
International Preliminary Report on Patentability issued by the International Searching Authority (ISA/US) on Apr. 2, 2009 in connection with International Application No. PCT/IL05/01035.
Written Opinion of the International Searching Authority (ISA/US) issued on Dec. 3, 2007 in connection with International Application No. PCT/IL05/01035.
Search Report issued by the Australian Patent Office on May 14, 2008 in connection with Singaporean Application/Patent No. 0702035-7.

Written Opinion issued by the Australian Patent Office on May 14, 2008 in connection with Singaporean Application/Patent No. 0702035-7.
Second Written Opinion issued by the Australian Patent Office on May 26, 2009 in connection with Singaporean Application No. 0702035-7.
Examination Report issued by the Australian Patent Office on Dec. 22, 2008 in connection with New Zealand Patent Application No. 553987.
Office Action issued by the Russian Patent Office on Jul. 20, 2009 in connection with Russian Patent Application No. 2007116168.
Office Action issued by the Japanese Patent Office on Feb. 8, 2011 in connection with Japanese Patent Application No. 2007-534174.
Non-final Office Action issued on May 1, 2008 in connection with U.S. Appl. No. 11/655,610, filed Jan. 18, 2007.
Response to Office Action issued on May 1, 2008 in connection with U.S. Appl. No. 11/655,610, filed Jun. 30, 2008.
Non-final Office Action issued on Oct. 2, 2008 in connection with U.S. Appl. No. 11/655,610, filed Jan. 18, 2007.
Response to Office Action issued on Oct. 2, 2008 in connection with U.S. Appl. No. 11/655,610, filed Dec. 31, 2008.
Notice of Allowance mailed on Apr. 7, 2009 in connection with Elena Feinstein et al., U.S. Appl. No. 11/655,610, filed Jan. 18, 2007 and allowed claims.
Amendment After Notice of Allowance filed on Sep. 22, 2010 in connection with Elena Feinstein, U.S. Appl. No. 11/655,610.
Oct. 13, 2010 Issue Notification and issued claims in Elena Feinstein, U.S. Appl. No. 11/655,610, filed Jan. 18, 2007.
Non-final Office Action issued on Jul. 22, 2009 in connection with U.S. Appl. No. 12/006,722, filed Jan. 4, 2008.
Response to Office Action issued on Jul. 22, 2009 in connection with U.S. Appl. No. 12/006,722, filed Jan. 21, 2010.
Non-final Office Action issued on Apr. 15, 2010 in connection with U.S. Appl. No. 12/006,722, filed Jan. 4, 2008.
Response to Office Action issued on Apr. 15, 2010 in connection with U.S. Appl. No. 12/006,722, filed Oct. 15, 2010.
Notice of Allowance mailed on Nov. 5, 2010 in connection with Elena Feinstein, U.S. Appl. No. 12/006,722, filed Jan. 4, 2008 and allowed claims.
Mar. 2, 2011 Issue Notification and issued claims in Elena Feinstein, U.S. Appl. No. 12/006,722, filed Jan. 4, 2008.
Non-final Official Action issued on Jan. 29, 2010, in connection with U.S. Appl. No. 12/459,617, filed Jul. 1, 2009.
Response to Office Action issued on Jan. 29, 2010 in connection with U.S. Appl. No. 12/459,617, filed Apr. 29, 2010.
Non-final Official Action issued on May 27, 2010, in connection with U.S. Appl. No. 12/459,617, filed Jul. 1, 2009.
Response to Office Action issued on May 27, 2010 in connection with U.S. Appl. No. 12/459,617, filed Nov. 24, 2010.
Final Official Action issued on Feb. 9, 2011, in connection with U.S. Appl. No. 12/459,617, filed Jul. 1, 2009.
Extended European Search Report issued May 17, 2011 in connection with European Patent Application No. 08763631.2.
International Search Report issued by the International Searching Authority (ISA/US) on Mar. 24, 2009 in connection with International Application No. PCT/EP2008/000874, filed Jun. 26, 2008.
International Search Report issued by the International Searching Authority (ISA/US) on Mar. 24, 2009 in connection with International Application No. PCT/IL2008/000874.
Written Opinion of the International Searching Authority (ISA/US) issued on Mar. 24, 2009 in connection with International Application No. PCT/IL2008/000874.
International Preliminary Report on Patentability issued by the International Searching Authority (ISA/US) on Jan. 19, 2010 in connection with International Application No. PCT/IL2008/000874.
Response and claim amendment filed Dec. 16, 2011 in reference to the Supplementary European Search Report dated May 17, 2011 in respect of EP 08763631.2 (EPO National Phase application of PCT/IL2008/000874).
Examination Report issued Jan. 20, 2012 in respect of EP 08763631.2 (EPO National Phase application of PCT/IL2008/000874).

(56) References Cited

OTHER PUBLICATIONS

Response to Examination Report issued Jan. 20, 2012 in respect of EP 08763631.2 (EPO National Phase application of PCT/IL2008/000874).

Claim amendments filed with the Response to Examination Report issued Jan. 20, 2012 in respect of EP 08763631.2 (EPO National Phase application of PCT/IL2008/000874).

Examination Report issued Nov. 26, 2012 in respect of EP 08763631.2 (EPO National Phase application of PCT/IL2008/000874).

COMPOSITIONS AND METHODS FOR REDUCING OR PROTECTING AGAINST DELAYED GRAFT FUNCTION (DGF)

This application is a §371 national stage application of PCT International Application No. PCT/IL2008/000874, filed Jun. 26, 2008, and claims the benefit of U.S. Provisional Applications Nos. 60/964,325, filed Aug. 10, 2007, and 60/937,318, filed Jun. 27, 2007, the contents of all of which are hereby incorporated by reference into this application.

This application incorporates-by-reference nucleotide and/or amino acid sequences which are present in the file named "184-PCT1 ST25 Apr. 2010.txt" which is 1,416,457 bytes in size, and which was created Apr. 21, 2010 in the IBM-PCT machine format, having an operating system compatibility with MS-Windows, which is contained on two duplicate compact discs labeled COPY 1 and COPY 2, and also labeled with the title, the name of each inventor, and the attorney docket number for this application.

Throughout this application various patent and scientific publications are cited. The disclosures for these publications in their entireties are hereby incorporated by reference into this application to more fully describe the state of the art to which this invention pertains.

FIELD OF THE INVENTION

The present invention relates to compounds, pharmaceutical compositions comprising same and methods of use thereof for the inhibition of certain pro-apoptotic genes, useful in the treatment of diseases and disorders in which gene expression is adverse. In particular embodiments, the invention provides siRNA oligonucleotides, compositions comprising same and methods of use thereof in the treatment of various diseases.

BACKGROUND OF THE INVENTION

RNA Interference

RNA interference (RNAi) is a phenomenon involving double-stranded (ds) RNA-dependent gene-specific posttranscriptional gene silencing. Originally, attempts to study this phenomenon and to manipulate mammalian cells experimentally were hindered by a non-specific antiviral defense mechanism activated in response to long dsRNA molecules (see Gil et al. Apoptosis 2000, 5:107-114). Later it was discovered that short, synthetic RNA duplexes of 21 nucleotides could mediate gene specific RNAi in mammalian cells, precluding stimulation of the generic antiviral defense mechanisms (see Elbashir et al. Nature 2001, 411:494-498; Caplen et al. PNAS USA 2001, 98:9742-9747). As a result, small interfering RNAs (siRNAs) have become powerful tools in attempting to understand gene function.

RNA interference (RNAi) in mammals is mediated by small interfering RNAs (siRNAs) (Fire et al, Nature 1998, 391:806) or microRNAs (miRNAs) (Ambros, Nature 2004, 431(7006):350-355; Bartel, Cell 2004, 116(2): 281-97). The corresponding process in plants is commonly referred to as specific post-transcriptional gene silencing (PTGS) or RNA silencing and is also referred to as quelling in fungi.

An siRNA is a double-stranded RNA or modified RNA molecule which down-regulates or silences (prevents) the expression of a gene/mRNA of its endogenous (cellular) counterpart. The mechanism of RNA interference is detailed infra.

Several studies have revealed that siRNA therapeutics is effective in vivo in both mammals and in humans. Bitko et al., have shown that specific siRNA molecules directed against the respiratory syncytial virus (RSV) nucleocapsid N gene are effective in treating mice when administered intranasally (Nat. Med. 2005, 11(1):50-55). Recent reviews discussing siRNA therapeutics are available (Barik, et al., J. Mol. Med. 2005, 83:764-773; Dallas and Vlassov, Med. Sci. Monitor 2006, 12(4):RA67-74; Chakraborty Current Drug Targets 2007, 8(3):469-82).

Mucke (IDrugs 2007 10(1):37-41) presents a review of current therapeutics, including siRNA to various targets, for the treatment of ocular diseases, for example age related macular degeneration (AMD) and glaucoma.

Pro-Apoptotic Genes

Pro-apoptotic genes are genes that encode proteins that play a role in apoptotic cell death. A non-limiting list of pro-apoptotic genes used in the present invention are: tumor protein p53 (P53 or TP53 which terms are used herein interchangeably); HtrA serine peptidase 2 (HTRA2); Kelch-like ECH associated protein 1 (KEAP1); Src homology 2 domain containing transforming protein 1 (SHC1-SHC, p66); zinc finger HIT type (ZNHIT1); lectin galactose-binding soluble 3 (LGALS3); and sestrin2 (HI95, SESN2).

Inhibition of one or more of the above genes is useful in the treatment and/or prevention of at least one of the following diseases or disorders and of other diseases disclosed herein: hearing loss, in particular chemical-induced ototoxicity, acute renal failure (ARF), chronic obstructive pulmonary disease (COPD), ischemia reperfusion injury following lung transplantation, lung cancer, acute respiratory disease syndrome (ARDS), spinal cord injury, pressure sores, osteoarthritis, diabetic retinopathy, oral mucositis, dry eye syndrome, ocular ischemic conditions and injury associated with organ transplant. The function of HI95 has been disclosed in Budanov et al., 2002, 21(39):6017-31.

Hearing Loss: Chemical-Induced Ototoxicity

The ototoxic effects of various therapeutic drugs on auditory cells and spiral ganglion neurons are often the limiting factor for their therapeutic usefulness. Main ototoxic drugs include the widely used chemotherapeutic agent cisplatin and its analogs, commonly used aminoglycoside antibiotics, e.g. gentamycin, for the treatment of infections caused by gram-negative bacteria, quinine and its analogs, salicylate and its analogs, and loop-diuretics.

For example, antibacterial aminoglycosides such as genta-mycins, streptomycins, kanamycins, tobramycins, and the like are known to have serious toxicity, particularly ototoxicity and nephrotoxicity, which reduce the value of such antimicrobials as therapeutic agents (see Goodman and Gilman's The Pharmacological Basis of Therapeutics, 6th ed., A. Goodman Gilman et al., eds; Macmillan Publishing Co., Inc., New York, 1980, pp. 1169-71).

Ototoxicity is a dose-limiting side-effect of antibiotic administration and of cisplatin, a platinum coordination complex, that has proven effective on a variety of human cancers including testicular, ovarian, bladder, and head and neck cancer. Platinum based drugs include carboplatin, cisplatin, oxaliplatin and satrapaltin inter alia; (see Kelland and Farrell eds., Platinum-based drugs in cancer therapy Human Press 2000; which is hereby incorporated by reference).

Cisplatin (Platinol®) and cisplatin-like compounds (platinum based compounds) damage auditory and vestibular systems.

Salicylates, such as aspirin, are the most commonly used therapeutic drugs for their anti-inflammatory, analgesic, antipyretic and anti-thrombotic effects. Unfortunately, they too have ototoxic side effects and can lead to tinnitus ("ringing in the ears") and temporary hearing loss. Moreover, if the drug is used at high doses for a prolonged time, chronic and irreversible hearing impairment can arise.

Without being bound by theory, it is believed that cisplatin drugs (cisplatin and cisplatin-like compounds) and other potentially ototoxic drugs (such as aminoglycoside antibiotics) may induce the ototoxic effects via programmed cell death or apoptosis in inner ear tissue, particularly inner ear hair cells (Mang et al., Neuroscience 2003, 120(1):191-205; Wang et al., J. Neuroscience 2003, 23(24):8596-8607). Presbycusis, age related hearing loss, is prevalent in the aging population with about 30-35 percent of adults between the ages of 65 and 75 years and about 40-50 percent of people aged 75 and older affected.

In mammals, auditory hair cells are produced only during embryonic development and do not regenerate if lost during postnatal life, therefore, loss of hair cells results in profound and irreversible deafness. Unfortunately, at present, there are no effective therapies to treat the cochlea and reverse this condition. Thus, an effective therapy to prevent cell death of auditory hair cells would be of great therapeutic value.

Accordingly, there exists a need for means to prevent, reduce or treat the incidence and/or severity diseases or disorders resulting from chemical toxicity including inner ear disorders and hearing impairment, renal damage (nephrotoxicity) and neural damage (neurotoxicity Acute Renal Failure Acute renal failure (ARF) is a clinical syndrome characterized by rapid deterioration of renal function that occurs within days. The principal feature of ARF is an abrupt decline in glomerular filtration rate (GFR), resulting in the retention of nitrogenous wastes (urea, creatinine). Worldwide, severe ARF occurs in about 170-200 per million population annually. To date, there is no specific treatment for established ARF. Several drugs have been found to ameliorate toxic and ischemic experimental ARF, as manifested by lower serum creatinine levels, reduced histological damage and faster recovery of renal function in different animal models. These include anti-oxidants, calcium channel blockers, diuretics, vasoactive substances, growth factors, anti-inflammatory agents and more. However, the drugs tested in clinical trials showed no benefit, and their use in clinical ARF has not been approved.

In the majority of hospitalized ARF patients, ARF is caused by acute tubular necrosis (ATN), which results from ischemic and/or nephrotoxic insults. Renal hypoperfusion is caused by hypovolemic, cardiogenic and septic shock, by administration of vasoconstrictive drugs, renovascular injury or kidney transplant. Nephrotoxins include exogenous toxins such as contrast media, aminoglycosides and cisplatin and cisplatin-like compounds as well as endogenous toxin such as myoglobin. Any chemical, biological or other agent which causes ARF or other kidney disease or disorder may be considered a nephrotoxin. Recent studies, however, support the theory that apoptosis in renal tissues is prominent in most human cases of ARF. The principal site of apoptotic cell death is the distal nephron. During the initial phase of ischemic injury, loss of integrity of the actin cytoskeleton leads to flattening of the epithelium, with loss of the brush border, loss of focal cell contacts, and subsequent disengagement of the cell from the underlying substratum. It has been suggested that apoptotic tubule cell death may be more predictive of functional changes than necrotic cell death (Komarov et al., Science 1999, 10; 285(5434):1733-7); Supavekin et al., Kidney Int. 2003, 63(5):1714-24).

In conclusion, currently there are no satisfactory modes of therapy for the prevention and/or treatment of acute renal failure, and there is a need therefore to develop novel compounds for this purpose.

Glaucoma

Glaucoma is one of the leading causes of blindness in the world. It affects approximately 66.8 million people worldwide and at least 12,000 Americans are blinded by this disease each year (Kahn and Milton, Am J. Epidemiol. 1980, 111(6):769-76). Glaucoma is characterized by the degeneration of axons in the optic nerve head, primarily due to elevated intraocular pressure (IOP). One of the most common forms of glaucoma, known as primary open-angle glaucoma (POAG), results from the increased resistance of aqueous humor outflow in the trabecular meshwork (TM), causing IOP elevation and eventual optic nerve damage.

Acute Respiratory Distress Syndrome

Acute respiratory distress syndrome (ARDS), also known as respiratory distress syndrome (RDS) or adult respiratory distress syndrome (in contrast with infant respiratory distress syndrome, IRDS) is a serious reaction to various forms of injuries to the lung. This is the most important disorder resulting in increased permeability pulmonary edema.

ARDS is a severe lung disease caused by a variety of direct and indirect insults. It is characterized by inflammation of the lung parenchyma leading to impaired gas exchange with concomitant systemic release of inflammatory mediators causing inflammation, hypoxemia and frequently resulting in multiple organ failure. This condition is life threatening, usually requiring mechanical ventilation and admission to an intensive care unit. A less severe form is called acute lung injury (ALI).

Spinal Cord Injury

Spinal cord injury or myelopathy, is a disturbance of the spinal cord that results in loss of sensation and/or mobility. The two common types of spinal cord injury are due to trauma and disease. Traumatic injury can be due to automobile accidents, falls, gunshot, diving accidents inter alia. and Diseases which can affect the spinal cord include polio, spina bifida, tumors and Friedreich's ataxia.

Ischemia Reperfusion Injury Following Lung Transplantation

Lung transplantation, the only definitive therapy for many patients with end stage lung disease, has poor survival rates in all solid allograft recipients. Ischemia reperfusion (IR) injury is one of the leading causes of death in lung allograft recipients.

Oral Mucositis

Oral mucositis, also referred to as a stomatitis, is a common and debilitating side effect of chemotherapy and radiotherapy regimens, which manifests itself as erythema and painful ulcerative lesions of the mouth and throat. Routine activities such as eating, drinking, swallowing, and talking may be difficult or impossible for subjects with severe oral mucositis. Palliative therapy includes administration of analgesics and topical rinses.

Dry Eye Syndrome

Dry eyes and dry eye syndrome are common problems usually resulting from a decrease in the production of tear film that lubricates the eyes. Most patients with dry eye experience discomfort, and no vision loss; although in severe cases, the cornea may become damaged or infected. Wetting drops (artificial tears) may be used for treatment while lubricating ointments may help more severe cases. Dry eyes is a hallmark symptom of Sjogren's syndrome.

Ocular Ischemic Conditions

Ischemic optic neuropathy (ION) includes a variety of disorders that produce ischemia to the optic nerve. By definition, ION is termed anterior if disc edema is present acutely, suggesting infarction of the portion of the optic nerve closest to the globe. ION also may be posterior, lying several centimeters behind the globe. Ischemic optic neuropathy usually occurs only in people older than 60 years of age. Most cases are nonarteritic and attributed to the effects of atherosclerosis, diabetes, or hypertension on optic nerve perfusion. Temporal arteritis causes about 5% of cases (arteritic ION).

Symptoms and signs are sudden, partial or complete vision loss, accompanied by swelling of the optic nerve head and often hemorrhage. Visual field defects may manifest as loss of half the visual field with a horizontal demarcation or as central or centrocecal (surrounding the natural blind spot) scotomata. Decreased vision is soon followed by pallor of the optic disk.

International patent application WO 00/44364 discloses TP53 inhibitors and their use for treatment of many diseases. International patent application no. WO 2006/035434 assigned to the assignee of the present invention discloses TP53 inhibitors for the treatment of, inter alia, acute renal failure and hearing loss). U.S. Pat. No. 7,074,895 assigned to the assignee of the present invention teaches full length HI95 polypeptide. GB 2420119 discloses certain KEAP1 siRNA. WO 03/087368 and WO 03/087367 teach methods of treating various eye and CNS diseases with RNAi to various target genes.

An effective therapy to treat the above mentioned diseases and disorders would be of great therapeutic value.

SUMMARY OF THE INVENTION

The present invention provides inhibitors of a pro-apoptotic gene selected from the group consisting of TP53; HTRA2; KEAP1; SHC1-SHC, ZNHIT1, LGALS3, and HI95. In particular the present invention provides novel double stranded oligonucleotides that inhibit or reduce expression of a pro-apoptotic gene selected from the group consisting of TP53; HTRA2; KEAP1; SHC1-SHC, ZNHIT1, LGALS3, and HI95, and pharmaceutical compositions comprising one or more such oligonucleotides or a vector capable of expressing the oligoribonucleotide. The present invention further relates to methods for treating or preventing the incidence or severity of various diseases or conditions in which gene expression is associated with the etiology or progression of the disease or condition.

In one aspect the present invention provides a compound having the structure:

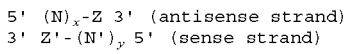

```
5'  (N)x-Z 3'  (antisense strand)
3'  Z'-(N')y 5'  (sense strand)
``` wherein each of N and N' is a nucleotide which may be modified or unmodified in its sugar residue;
wherein each of $(N)_x$ and $(N')_y$ is an oligonucleotide in which each consecutive N or N' is joined to the next N or N' by a covalent bond;
wherein each of x and y is an integer between 18 and 40;
wherein each of Z and Z' may be present or absent, but if present is 1-5 nucleotides covalently attached at the 3' terminus of the strand in which it is present; and
wherein the sequence of (N)x comprises an antisense sequence relative to the mRNA transcribed from a mammalian gene selected from the group consisting of TP53 (SEQ ID NO:3); HTRA2 (SEQ ID NOS:4-5); KEAP1 (SEQ ID NOS: 6-7); SHC1-SHC (SEQ ID NOS:8-9), ZNHIT1 (SEQ ID NO:10), LGALS3 (SEQ ED NOS:11-12), and HI95 (SEQ ID NO:13).

In some embodiments the compound comprises a phosphodiester bond. In various embodiments the compound comprises ribonucleotides wherein x=y and wherein x is an integer selected from the group consisting of 19, 20 and 21. In preferred embodiments x=y=19.

In some embodiments the compound is blunt ended, for example wherein Z and Z' are both absent. In an alternative embodiment, the compound comprises at least one 3' overhang, wherein at least one of Z or Z' is present. Z and Z' can be independently comprise one or more covalently linked modified or non-modified nucleotides, as described infra, for example inverted dT or dA; dT, LNA, mirror nucleotide and the like. In some embodiments each of Z and Z' are independently selected from dT and dTdT.

In some embodiments the compound comprises one or more ribonucleotides unmodified in their sugar residues. In other embodiments the compound comprises at least one ribonucleotide modified in the sugar residue. In some embodiments the compound comprises a modification at the 2' position of the sugar residue. Modifications in the 2' position of the sugar residue include amino, fluoro, methoxy, alkoxy and alkyl moieties. In certain preferred embodiments the modification comprises a ribonucleotide comprising a methoxy moiety at the 2' position (2'-O-methyl; 2'-O-Me; 2'-O—CH$_3$) of the sugar residue.

In some embodiments the compound comprises modified alternating ribonucleotides in one or both of the antisense and the sense strands. In preferred embodiments the compound comprises modified alternating ribonucleotides in the antisense and the sense strands. In some preferred embodiments the middle ribonucleotide of the antisense strand is not modified; e.g. ribonucleotide in position 10 in a 19-mer strand.

In additional embodiments the compound comprises modified ribonucleotides in alternating positions wherein the ribonucleotides at the 5' and 3' termini of the antisense strand are modified in their sugar residues, and the ribonucleotides at the 5' and 3' termini of the sense strand are unmodified in their sugar residues. In some embodiments, neither the antisense nor the sense strands are phosphorylated at the 3' and 5' termini. In other embodiments either or both the antisense and the sense strands are phosphorylated at the 3' termini.

In various embodiments the compound comprises an antisense sequence set forth in any one of SEQ ID NOS: 459-849, 1271-1691, 1873-2053, 2263-2471, 2697-2921, 3179-3435, 3578-3718, 3878-4035, 4198-4359, 4534-4709, 4870-5029, 5206-5381, 5726-6069, 6443-6815. In other embodiments the present invention provides a mammalian expression vector comprising an antisense sequence set forth in any one of SEQ ID NOS: 459-849, 1271-1691, 1873-2053, 2263-2471, 2697-2921, 3179-3435, 3578-3718, 3878-4035, 4198-4359, 4534-4709, 4870-5029, 5206-5381, 5726-6069, 6443-6815.

In certain preferred embodiments the present invention provides a compound having the structure

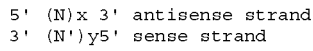

```
5'  (N)x 3'  antisense strand
3'  (N')y 5'  sense strand
``` wherein x and y=19; and (N)x and (N)y are fully complementary;
wherein alternating ribonucleotides in the antisense and the sense strands are modified to result in a 2'-O-methyl modification in the sugar residue of the ribonucleotides;

wherein the ribonucleotides at the 5' and 3' termini of the antisense strand are modified;
wherein the ribonucleotides at the 5' and 3' termini of the sense strand are unmodified;
wherein the antisense and the sense strands are phosphorylated or non-phosphorylated at the 3' and 5' termini; and
wherein each of Nx and N'y is selected from the group of oligomers set forth in SEQ ID NOS:68-6815. In certain embodiments the (N)x and (N')y are selected from the oligomers set forth in SEQ NOS:6816-7107.

In a second aspect the present invention provides a pharmaceutical composition comprising one or more compounds of the present invention, in an amount effective to inhibit human gene expression wherein the gene is selected from the group consisting of TP53; HTRA2; KEAP1; SHC1-SHC, ZNHIT1, LGALS3 and HI95; and a pharmaceutically acceptable carrier.

In another aspect, the present invention relates to a method for the treatment of a subject in need of treatment for a disease or disorder associated with the expression of a pro-apoptotic gene wherein the gene is selected from TP53; HTRA2; KEAP1; SHC1-SHC, ZNHIT1, LGALS3, and HI95, comprising administering to the subject an amount of an siRNA which reduces or inhibits expression of at least one of the pro-apoptotic genes.

More specifically, the present invention provides methods and compositions useful in treating a subject suffering from or at risk of acute renal failure (ARF), hearing loss including chemical-induced oxotoxicity, glaucoma, diabetic retinopathy, ischemic optic neuropathy (ION), dry eye syndrome, acute respiratory distress syndrome (ARDS) and other acute lung and respiratory injuries, injury (e.g. ischemia-reperfusion injury) in organ transplant including lung, kidney, bone marrow, heart, pancreas, cornea or liver transplantation, nephrotoxicity, nephritis, neurotoxicity, spinal cord injury, osteoarthritis (OA), oral mucositis, pressure sores, and chronic obstructive pulmonary disease (COPD).

The methods of the invention comprise administering to a subject in need thereof one or more inhibitory compounds which down-regulate expression of a pro-apoptotic gene selected from the group consisting of TP53; HTRA2; KEAP1; SHC1-SHC, ZNHIT1, LGALS3 and HI95; in a therapeutically effective dose so as to thereby treat the subject.

In various embodiments the inhibitor is selected from the group consisting of an siRNA, shRNA, an aptamer, an antisense molecule, miRNA, a ribozyme, and an antibody. In preferred embodiments the inhibitor is siRNA.

The present invention further relates to the use of compounds which down-regulate the expression of a proapoptotic gene, particularly to small interfering RNAs (siRNAs), in the treatment of various diseases, conditions or disorders associated with TP53; HTRA2; KEAP1; SHC1-SHC, ZNHIT1, LGALS3, and HI95 gene expression including acute renal failure (ARF), hearing loss including chemical-induced oxotoxicity, glaucoma, diabetic retinopathy, ischemic optic neuropathy, dry eye syndrome, acute respiratory distress syndrome (ARDS) and other acute lung and respiratory injuries, injury (e.g. ischemia-reperfusion injury) in organ transplant including lung, kidney, bone marrow, heart, pancreas, cornea or liver transplantation, nephrotoxicity, nephritis, neurotoxicity, spinal cord injury, osteoarthritis (OA), oral mucositis, pressure sores, and chronic obstructive pulmonary disease (COPD).

Another aspect of the invention provides a method of preventing or reducing the symptoms of Delayed Graft Function in a recipient of a kidney transplant, comprising administering to one or both of the donor and the recipient of the kidney transplant a composition comprising a therapeutically effective dose of a compound having the structure:

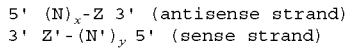

wherein each of N and N' is a nucleotide selected from an unmodified ribonucleotide, and a modified ribonucleotide;
wherein each of (N)x and (N')y is an oligomer in which each consecutive ribonucleotide is joined to the next ribonucleotide by a covalent bond and each of x and y is an integer between 18 and 40;
wherein in each of (N)x and (N')y the nucleotides alternate between modified ribonucleotides and unmodified ribonucleotides each modified ribonucleotide being modified so as to have a 2'-O-methyl on its sugar;
wherein each of Z and Z' may be present or absent, but if present is 1-5 deoxyribonucleotides covalently attached at the 3' terminus of the oligomer to which it is attached;
and wherein the antisense strand of the compound comprises the sequence UGAAGGGUGAAAUAUUCUC (SEQ ID NO:2) and the sense strand of the compound comprises the sequence GAGAAUAUUUCACCCUUCA (SEQ ID NO:1), thereby preventing or reducing the symptoms of Delayed Graft Function in the recipient.

Another aspect of the invention is a method of preventing or reducing the symptoms of Delayed Graft Function in a recipient of a kidney transplant, comprising administering to one or both of the donor and the recipient of the kidney transplant an oligonucleotide, preferably an siRNA, which reduces or inhibits expression of the TP53 gene, thereby preventing or reducing the symptoms of Delayed Graft Function in the recipient.

Lists of 19- and 21-mer sense and corresponding antisense sequences useful in preparation of siRNA compounds are set forth in SEQ ID NOS:68-6815.

A list of preferred siRNA to TP53 is provided in SEQ ID NOS:68-1691.

A list of preferred siRNA to HTRA2 is provided in SEQ ID NOS:1692-2471.

A list of preferred siRNA to KEAP1 is provided in SEQ ID NOS: 2472-3435.

A list of preferred siRNA to SHC1-SHC is provided in SEQ ID NOS:3436-4035.

A list of preferred siRNA to ZNHIT1 is provided in SEQ ID NOS:4036-4709.

A list of preferred siRNA to LGAL3 is provided in SEQ ID NOS:4710-5381.

A list of preferred siRNA to HI95 is provided in SEQ ID NOS:5382-6815.

Currently more preferred siRNA compounds are set forth in SEQ ID NOS:6816-s7107.

Known compounds, compositions and methods are explicitly excluded from the present invention.

These and further features of the present invention will be better understood in conjunction with the detailed description, examples and claims that follow.

DETAILED DESCRIPTION OF THE INVENTION

The present invention relates generally to compounds which down-regulate expression of TP53; HTRA2; KEAP1; SHC1-SHC, ZNHIT1, LGALS3, and HI95 genes, particularly to novel small interfering RNAs (siRNAs), and to the use of these siRNAs in the treatment of various diseases and medical conditions. Particular diseases and conditions to be treated are acute renal failure (ARF), hearing loss including chemical-induced oxotoxicity, glaucoma, diabetic retinopathy, ischemic optic neuropathy, dry eye syndrome, acute respiratory distress syndrome (ARDS) and other acute lung and respiratory injuries, injury (e.g. ischemia-reperfusion injury) in organ transplant including lung, kidney, bone marrow, heart, pancreas, cornea or liver transplantation, nephrotoxicity, nephritis, neurotoxicity, spinal cord injury, osteoarthritis (OA), oral mucositis, pressure sores, and chronic obstructive pulmonary disease (COPD).

Lists of preferred siRNA are provided in SEQ ID NOS:68-6815. The separate lists of 19-mer and 21-mer siRNAs are prioritized based on their score according to a proprietary algorithm as the best sequences for targeting the human gene expression. Methods, molecules and compositions, which inhibit the pro-apoptotic genes are discussed herein at length, and any of said molecules and/or compositions may be beneficially employed in the treatment of a subject suffering from or at risk of developing any of said conditions. 19-mer oligomers are set forth in SEQ ID NOS:68-849, 1692-2053, 2472-2921, 3436-3718, 4036-4359, 4710-5029 and 5382-6069. 21-mer oligomers are set forth in SEQ ID NOS:850-1691, 2054-2471, 2922-3435, 3720-4035, 4360-4709, 5030-5381 and 6070-6815. The oligomers are useful in the synthesis of siRNA compounds and pharmaceutical compositions comprising same.

DEFINITIONS

For convenience certain terms employed in the specification, examples and claims are described herein.

An "inhibitor" is a compound which is capable of inhibiting or reducing the expression or activity of a gene or the product of such gene to an extent sufficient to achieve a desired biological or physiological effect. The term "inhibitor" as used herein refers to one or more of an oligonucleotide inhibitor, including siRNA, shRNA, aptamers, antisense molecules, miRNA and ribozymes, as well as antibodies.

Table 1 below provides a list of the proapoptotic genes of the present invention, the gene identification (gi) numbers, as well as Genbank identifiers, known isoforms, and indications.

TABLE 1

| Gene | Full name and Human Gene ID | Indications or diseases to be treated according to the present invention* |
|---|---|---|
| p53 (TP53) | tumor protein p53 gi8400737, NM_000546.2 (SEQ ID NO: 3) | organ transplant (e.g. lung, kidney), glaucoma, hearing loss, acute kidney injury, acute lung injury, ischemic optic neuropathy (ION) |
| HTRA2 | Htra serine peptidase 2 var 1 gi: 73747817, NM_013247 (SEQ ID NO: 4) var 2 gi: 73747818, NM_145074 (SEQ ID NO: 5) | acute renal failure, hearing loss, ARDS, glaucoma, spinal cord injury, COPD, osteoarthritis, diabetic retinopathy, toxicity, organ transplant, acute ischemia-reperfusion lung injury |
| KEAP1 | Kelch-like ECH-associated protein 1 var 1 gi: 45269144 NM_203500 (SEQ ID NO: 6) var 2 gi: 45269143 NM_012289 (SEQ ID NO: 7) | acute renal failure, hearing loss, ARDS, glaucoma, spinal cord injury, COPD, osteoarthritis, diabetic retinopathy, pressure sores, nephrotoxicity, neurotoxicity, organ transplant |
| SHC1 | Src homology 2 domain containing) transforming prot. 1 var 1 gi: 52693920 NM_183001 (SEQ ID NO: 8) var 2 gi: 34147725 NM_003029 (SEQ ID NO: 9) | acute renal failure, hearing loss, ARDS, glaucoma, spinal cord injury, COPD, osteoarthritis, diabetic retinopathy, pressure sores, toxicity, organ transplant, acute ischemia-reperfusion lung injury |
| ZNHIT1 | Zn finger HIT type 1 gi: 37594439|; NM_006349 (SEQ ID NO: 10) | acute renal failure, hearing loss, ARDS, glaucoma, spinal cord injury, COPD, osteoarthritis, diabetic retinopathy, pressure sores, toxicity, organ transplant |
| LGALS3 | lectin galactoside-binding soluble 3 var 1 gi: 115430222 NM_002306 (SEQ ID NO: 11) var 2 gi: 115430224 NR_003225 (SEQ ID NO: 12) | acute renal failure, hearing loss, ARDS, glaucoma, spinal cord injury, COPD, osteoarthritis, diabetic retinopathy, pressure sores, organ transplant |
| HI95 | Sestrin2 gi: 32454742 NM_031459 (SEQ ID NO: 13) | acute renal failure, hearing loss, ARDS, glaucoma, spinal cord injury, COPD, osteoarthritis, diabetic retinopathy, pressure sores, organ transplant |

*Toxicity includes chemically induced (in a non-limiting example cisplatin and cisplatin analogs and aminoglycoside antibiotic ototoxicity, neurotoxicity and nephrotoxicity. Organ transplant includes inter alia lung, heart, kidney, liver and bone marrow.
ION: ischemic ocular neuropathy;
COPD: chronic obstructive pulmonary disorder;
ARDS: acute respiratory distress syndrome;

As used herein, the term "polypeptide" refers to, in addition to a polypeptide, an oligopeptide, peptide and a full protein. The present invention provides compounds that inhibit one or more isoforms of a gene, in the event that more than one isoforms exits.

RNA Interference and siRNA

RNA interference (RNAi) is based on the ability of dsRNA species to enter a cytoplasmic protein complex, where it is then targeted to the complementary cellular RNA and specifically degrade it. The RNA interference response features an endonuclease complex containing an siRNA, commonly referred to as an RNA-induced silencing complex (RISC), which mediates cleavage of single-stranded RNA having a sequence complementary to the antisense strand of the siRNA duplex. Cleavage of the target RNA may take place in the middle of the region complementary to the antisense strand of the siRNA duplex (Elbashir et al., Genes Dev., 2001, 15(2): 188-200). In more detail, longer dsRNAs are digested into short (17-29 bp) dsRNA fragments (also referred to as short inhibitory RNAs, "siRNAs") by type III RNAses (DICER, DROSHA, etc.; Bernstein et al., Nature, 2001, 409(6818): 363-6; Lee et al., Nature, 2003, 425(6956):415-9). The RISC protein complex recognizes these fragments and complementary mRNA. The whole process is culminated by endonuclease cleavage of target mRNA (McManus & Sharp, Nature Rev Genet, 2002, 3(10):737-47; Paddison & Hannon, Curr Opin Mol Ther. 2003, 5(3):217-24). (For additional information on these terms and proposed mechanisms, see for example Bernstein et al., RNA 2001, 7(11):1509-21; Nishikura, Cell 2001, 107(4):415-8 and PCT publication WO 01/36646).

The selection and synthesis of siRNA corresponding to known genes has been widely reported; see for example Ui-Tei et al., J Biomed Biotechnol. 2006; 2006: 65052; Chalk et al., Biochem. Biophys. Res. Comm. 2004, 319(1): 264-74; Sioud & Leirdal, Met. Mol. Biol.; 2004, 252:457-69; Levenkova et al., Bioinform. 2004, 20(3):430-2; Ui-Tei et al., Nuc. Acid Res. 2004, 32(3):936-48. For examples of the use of, and production of, modified siRNA see Braasch et al., Biochem., 2003, 42(26):7967-75; Chiu et al., RNA, 2003, 9(9): 1034-48; PCT publications WO 2004/015107 (Atugen); WO 02/44321 (Tuschl et al), and U.S. Pat. Nos. 5,898,031 and 6,107,094. See also Dykxhoorn et al Gene Therapy (2006), 13,541-552.

Several groups have described the development of DNA-based vectors capable of generating siRNA within cells. The method generally involves transcription of short hairpin RNAs that are efficiently processed to form siRNAs within cells (Paddison et al. PNAS USA 2002, 99:1443-1448; Paddison et al. Genes & Dev 2002, 16:948-958; Sui et al. PNAS USA 2002, 8:5515-5520; and Brummelkamp et al. Science 2002, 296:550-553). These reports describe methods to generate siRNAs capable of specifically targeting numerous endogenously and exogenously expressed genes.

As used herein, the term "nucleic acid" refers to polynucleotides such as deoxyribonucleic acid (DNA), and, where appropriate, ribonucleic acid (RNA). The terms should also be understood to include, as equivalents, analogs of either RNA or DNA made from nucleotide analogs, and, as applicable to the embodiment being described, double-stranded polynucleotides and single-stranded polynucleotides such as sense or antisense.

"Oligonucleotide" refers to a sequence having from about 2 to about 50 linked nucleotides or linked modified nucleotides, or a combination of modified and unmodified nucleotide. Oligonucleotide includes the terms oligomer, antisense strand and sense strand.

"Nucleotide" is meant to encompass deoxyribonucleotides and ribonucleotides, which may be natural or synthetic, and or modified or unmodified. Modifications include changes to the sugar moiety, the base moiety and or the linkages between ribonucleotides in the oligoribonucleotide.

All analogues of, or modifications to, a nucleotide/oligonucleotide may be employed with the present invention, provided that said analogue or modification does not substantially affect the function of the nucleotide/oligonucleotide. The nucleotides can be selected from naturally occurring or synthetic modified bases. Naturally occurring bases include adenine, guanine, cytosine, thymine and uracil. Modified bases of nucleotides include inosine, xanthine, hypoxanthine, 2-aminoadenine, 6-methyl, 2-propyl and other alkyl adenines, 5-halo uracil, 5-halo cytosine, 6-aza cytosine and 6-aza thymine, pseudo uracil, 4-thiouracil, 8-halo adenine, 8-aminoadenine, 8-thiol adenine, 8-thioalkyl adenines, 8-hydroxyl adenine and other 8-substituted adenines, 8-halo guanines, 8-amino guanine, 8-thiol guanine, 8-thioalkyl guanines, 8-hydroxyl guanine and other substituted guanines, other am and deaza adenines, other aza and deaza guanines, 5-trifluoromethyl uracil and 5-trifluoro cytosine.

In addition, analogues of polynucleotides can be prepared wherein the structure of one or more nucleotide is fundamentally altered and better suited as therapeutic or experimental reagents. An example of a nucleotide analogue is a peptide nucleic acid (PNA) wherein the deoxyribose (or ribose) phosphate backbone in DNA (or RNA) is replaced with a polyamide backbone which is similar to that found in peptides. PNA analogues have been shown to be resistant to enzymatic degradation and to have extended lives in vivo and in vitro. Other modifications that can be made to oligonucleotides include polymer backbones, cyclic backbones, acyclic backbones, thiophosphate-D-ribose backbones, triester backbones, thioate backbones, 2'-5' bridged backbone, artificial nucleic acids, morpholino nucleic acids, locked nucleic acid (LNA), glycol nucleic acid (GNA), threose nucleic acid (TNA), arabinoside, and mirror nucleoside (for example, beta-L-deoxynucleoside instead of beta-D-deoxynucleoside). Examples of siRNA compounds comprising LNA nucleotides are disclosed in Elmen et al., (NAR 2005. 33(1): 439-447).

The compounds of the present invention can be synthesized using one or more inverted nucleotides, for example inverted thymidine or inverted adenine (for example see Takei, et al., 2002. JBC 277(26):23800-06.

Certain structures include an siRNA compound having one or a plurality of 2'-5' internucleotide linkages (bridges).

A "mirror" nucleotide is a nucleotide with reversed chirality to the naturally occurring or commonly employed nucleotide, i.e., a mirror image (L-nucleotide) of the naturally occurring (D-nucleotide). The nucleotide can be a ribonucleotide or a deoxyribonucleotide and my further comprise at least one sugar, base and or backbone modification. U.S. Pat. No. 6,602,858 discloses nucleic acid catalysts comprising at least one L-nucleotide substitution.

The present invention provides methods and compositions for inhibiting expression of a pro-apoptotic gene in vivo. In general, the method includes administering oligoribonucleotides, in particular small interfering RNAs (i.e., siRNAs) or a nucleic acid material that can produce siRNA in a cell, that targets an mRNA transcribed from a pro-apoptotic gene in an amount sufficient to down-regulate expression of a target gene by an RNA interference mechanism. In particular, the subject method can be used to inhibit expression of pro-apoptotic gene for treatment of a disease.

In accordance with the present invention, the siRNA compounds or other inhibitors of the pro-apoptotic genes are used as drugs to treat various pathologies.

The present invention provides double-stranded oligoribonucleotides (eg. siRNAs), which down-regulate the expression of the pro-apoptotic genes selected from the group consisting of TP53; HTRA2; KEAP1; SHC1-SHC, ZNHIT1, LGALS3, and HI-95.

There are at least four variant TP53 polypeptides (Bourdon et al. *Genes Dev.* 2005; 19: 2122-2137). All variants are included in the definition of TP53 polypeptides and in the definition of the TP53 genes encoding them.

An siRNA of the invention is a duplex oligoribonucleotide in which the sense strand is derived from the mRNA sequence of the pro-apoptotic genes, and the antisense strand is complementary to the sense strand. In general, some deviation from the target mRNA sequence is tolerated without compromising the siRNA activity (see e.g. Czauderna et al., NAR 2003, 31(11):2705-2716). An siRNA of the invention inhibits gene expression on a post-transcriptional level with or without destroying the mRNA. Without being bound by theory, siRNA may target the mRNA for specific cleavage and degradation and/or may inhibit translation from the targeted message.

In some embodiments the oligoribonucleotide according to the present invention comprises modified siRNA. In various embodiments the siRNA comprises an RNA duplex comprising a first strand and a second strand, whereby the first strand comprises a ribonucleotide sequence at least partially complementary to about 18 to about 40 consecutive nucleotides of a target nucleic acid, and the second strand comprises ribonucleotide sequence at least partially complementary to the first strand and wherein said first strand and/or said second strand comprises a plurality of groups of modified ribonucleotides having a modification at the 2'-position of the sugar moiety whereby within each strand each group of modified ribonucleotides is flanked on one or both sides by a group of flanking ribonucleotides whereby each ribonucleotide forming the group of flanking ribonucleotides is selected from an unmodified ribonucleotide or a ribonucleotide having a modification different from the modification of the groups of modified ribonucleotides.

The group of modified ribonucleotides and/or the group of flanking ribonucleotides comprise a number of ribonucleotides selected from the group consisting of an integer from 1 to 10. Accordingly, the group thus comprises one nucleotide, two nucleotides, three nucleotides, four nucleotides, five nucleotides, six nucleotides, seven nucleotides, eight nucleotides, nine nucleotides or ten nucleotides.

The groups of modified nucleotides and flanking nucleotides may be organized in a pattern on at least one of the strands.

In some embodiments the first and second strands comprise a pattern of modified nucleotides. In various embodiments the pattern of modified nucleotides of said first strand is identical relative to the pattern of modified nucleotides of the second strand.

In other embodiments the pattern of modified nucleotides of said first strand is shifted by one or more nucleotides relative to the pattern of modified nucleotides of the second strand.

In some preferred embodiments the middle ribonucleotide in the first strand (antisense) is an unmodified nucleotide. For example, in a 19-oligomer antisense strand, ribonucleotide number 10 is unmodified; in a 21-oligomer antisense strand, ribonucleotide number 11 is unmodified; and in a 23-oligomer antisense strand, ribonucleotide number 12 is unmodified. The modifications or pattern of modification, if any, of the siRNA must be planned to allow for this.

The modifications on the 2' moiety of the sugar residue include amino, fluoro, alkoxy including methoxy, alkyl, amino, fluoro, chloro, bromo, CN, CF, imidazole, carboxylate, thioate, $C_1$ to $C_{10}$ lower alkyl, substituted lower alkyl, alkaryl or aralkyl, $OCF_3$, OCN, O—, S—, or N— alkyl; O—, S, or N-alkenyl; $SOCH_3$; $SO_2CH_3$; $ONO_2$; $NO_2$, $N_3$; heterozycloalkyl; heterozycloalkaryl; aminoalkylamino; polyalkylamino or substituted silyl, as described, inter alia, in European patents EP 0 586 520 B1 and EP 0 618 925 B1.

In some embodiments the siRNA is blunt ended, on one or both ends. More specifically, the siRNA may be blunt ended on the end defined by the 5'-terminus of the first strand and the 3'-terminus of the second strand, or the end defined by the 3'-terminus of the first strand and the 5'-terminus of the second strand, or both ends.

In other embodiments at least one of the two strands may have an overhang of at least one nucleotide at the 5'-terminus; the overhang may consist of at least one deoxyribonucleotide. At least one of the strands may also optionally have an overhang of at least one nucleotide at the 3'-terminus. The overhang may consist of from about 1 to about 4 nucleotides.

The length of RNA duplex is from about 18 to about 40 ribonucleotides, preferably 19 to 23 ribonucleotides. Further, the length of each strand (oligomer) may independently have a length selected from the group consisting of about 15 to about 40 bases, preferably 18 to 23 bases and more preferably 19, 20 or 21 ribonucleotides.

Additionally, in certain preferred embodiments the complementarity between said first strand and the target nucleic acid can be perfect. In some embodiments, the strands are substantially complementary, i.e. having one, two or up to three mismatches between said first strand and the target nucleic acid.

In some embodiments the first strand and the second strand each comprise at least one group of modified ribonucleotides and at least one group of flanking ribonucleotides, whereby each group of modified ribonucleotides comprises at least one ribonucleotide and whereby each group of flanking ribonucleotides comprises at least one ribonucleotide, wherein each group of modified ribonucleotides of the first strand is aligned with a group of flanking ribonucleotides on the second strand, and wherein the 5' most terminal ribonucleotide is selected from a group of modified ribonucleotides, and the 3' most terminal ribonucleotide of the second strand is a selected from the group of flanking ribonucleotide. In some embodiments each group of modified ribonucleotides consists of a single ribonucleotide and each group of flanking ribonucleotides consists of a single nucleotide.

In yet other embodiments the ribonucleotide forming the group of flanking ribonucleotides on the first strand is an unmodified ribonucleotide arranged in a 3' direction relative to the ribonucleotide forming the group of modified ribonucleotides, and the ribonucleotide forming the group of modified ribonucleotides on the second strand is a modified ribonucleotide which is arranged in 5' direction relative to the ribonucleotide forming the group of flanking ribonucleotides. In some embodiments the first strand of the siRNA comprises five to about twenty, eight to twelve, preferably ten or twelve groups of modified ribonucleotides, and the second strand comprises seven to eleven, preferably nine or eleven groups of modified ribonucleotides. The first strand and the second strand may be linked by a loop structure, which may be comprised of a non-nucleic acid polymer such as, inter alia, polyethylene glycol. Alternatively, the loop structure may be comprised of a nucleic acid, including modified and non-modified ribonucleotides and modified and non-modified deoxyribonucleotides.

Further, the 5'-terminus of the first strand of the siRNA may be linked to the 3'-terminus of the second strand, or the 3'-terminus of the first strand may be linked to the 5'-terminus of the second strand, said linkage being via a nucleic acid linker typically having a length between 3-100 nucleotides, preferably about 3 to about 10 nucleotides.

In various embodiments, the present invention provides a compound having structure A:

```
5' (N)x-Z 3'   (antisense strand)
3' Z'-(N')y 5' (sense strand)
``` wherein each N and N' is a ribonucleotide selected from the group consisting of a modified ribonucleotide or an unmodified ribonucleotide and each of $(N)_x$ and $(N')_y$ is an oligomer in which each consecutive N or N' is joined to the next N or N' by a covalent bond;

wherein each of x and y is an integer between 18 and 40;

wherein each of Z and Z' may be present or absent, but if present is 1-5 nucleotides covalently attached at the 3' terminus of the strand in which it is present;

and wherein the sequence of (N)x comprises an antisense sequence relative to the mRNA transcribed from a mammalian gene selected from the group consisting of TP53; HTRA2; KEAP1; SHC1-SHC, ZNHIT1, LGALS3, and HI95.

Z and Z' are preferably independently selected from the group consisting of dT (deoxythymine) and dTdT.

In certain embodiments the antisense and sense sequences are selected from the sequences set forth in SEQ ID NOS:68-6815. In preferred embodiments the antisense and sense 19mer sequences are selected from sequences set forth in SEQ ID NOS: 68-849, 1692-2053, 2472-2921, 3436-3718, 4036-4359, 4710-5029 and 5382-6069. All sequences are provided in 5'-3' orientation. Where cross-species specificity is known, the species is (are) listed, as well. The abbreviations in the tables are as follows: GIMP chimpanzee, MO mouse, CHL chinchilla, MK monkey, RB rabbit, GP guinea pig.

Certain preferred siRNA compounds comprise the following oligomer pairs (both sense and antisense oligomers are shown in 5'-3' orientation):

```
TP53: (#1 in Table A) (Sequence disclosed in
WO 2006/035434; I5)
Sense: GAGAAUAUUUCACCCUUCA
(SEQ ID NO: 2)
Antisense: UGAAGGGUGAAAUAUUCUC
(SEQ ID NO: 1)

TP53 (#44 in Table A) (Sequence disclosed in
WO 2006/035434; F3)
Sense: CCGAGUGGAAGGAAAUUUG
(SEQ ID NO: 7099)
Antisense: CAAAUUUCCUUCCACUCGG
(SEQ ID NO: 7102)

TP53 (#198 in Table A) (Sequence disclosed in
WO 2006/035434; G1)
Sense: GACAGAAACACUUUUCGAC
(SEQ ID NO: 7100)
Antisense: GUCGAAAAGUGUUUCUGUC
(SEQ ID NO: 7103)

HTRA2_11 (#2 in Table C and present in Table P)
Sense: GAAUCACAGAAACACUUUU
(SEQ ID NO: 6816)
Antisense: AAAAGUGUUUCUGUGAUUC
(SEQ ID NO: 6859)

HTRA2_ (#3 in Table C)
Sense: GGCCUGGUGAUGUGAUUUU
(SEQ ID NO: 1694)
Antisense: AAAAUCACAUCACCAGGCC
(SEQ ID NO: 1875)

HTRA2_13 (#5 in Table C)
Sense: CCGUGGUCUAUAUCGAGAU
(SEQ ID NO: 1696)
Antisense: AUCUCGAUAUAGACCACGG
(SEQ ID NO: 1877)

HTRA2_15 (#13 in Table C)
Sense: CCUAGCAACAUAUUAUAGU
(SEQ ID NO: 1704)
Antisense: ACUAUAAUAUGUUGCUAGG
(SEQ ID NO: 1885)

HTRA2_16 (#20 in Table C and present in Table P)
Sense: GCCGUGGUCUAUAUCGAGA
(SEQ ID NO: 1711)
Antisense: UCUCGAUAUAGACCACGGC
(SEQ ID NO: 1892)

HTRA2_17 (#55 in Table C and present in Table P)
Sense: GUGCUGCUCUUUGUGGUGU
(SEQ ID NO: 1746)
Antisense: ACACCACAAAGAGCAGCAC
(SEQ ID NO: 1927)

HTRA2_18 (#179 in Table C)
Sense: CAGCUAUUGAUUUUGGAAA
(SEQ ID NO: 1870)
Antisense: UUUCCAAAAUCAAUAGCUG
(SEQ ID NO: 2051)

HTRA2_21 (#180 in Table C)
Sense: GCUAUUGAUUUUGGAAACU
(SEQ ID NO: 1871)
Antisense: AGUUUCCAAAAUCAAUAGC
(SEQ ID NO: 2052)

HTRA2_22 (#181 in Table C)
Sense: AGCUAUUGAUUUUGGAAAC
(SEQ ID NO: 1872)
Antisense: GUUUCCAAAAUCAAUAGCU
(SEQ ID NO: 2053)

KEAP1_2 (#5 in Table E)
Sense: GCCUCAUUGAAUUCGCCUA
(SEQ ID NO: 2476)
Antisense: UAGGCGAAUUCAAUGAGGC
(SEQ ID NO: 2701)

KEAP1_11 (#20 in Table E and present in Table P)
Sense: CACCAUGUGAUUUAUUCUU
(SEQ ID NO: 2491)
Antisense: AAGAAUAAAUCACAUGGUG
(SEQ ID NO: 2716)

KEAP1_12 (#21 in Table E and present in Table P)
Sense: ACUGCAAAUAACCCAUCUU
(SEQ ID NO: 2492)
Antisense: AAGAUGGGUUAUUUGCAGU
(SEQ ID NO: 2717)

KEAP1_13 (#28 in Table E and present in Table P)
Sense: CACUGCAAAUAACCCAUCU
(SEQ ID NO: 2499)
Antisense: AGAUGGGUUAUUUGCAGUG
(SEQ ID NO: 2724)

KEAP1_14 (#37 in Table E and present in Table P)
Sense: GCAGCUGUCACCAUGUGAU
(SEQ ID NO: 2508)
Antisense: AUCACAUGGUGACAGCUGC
(SEQ ID NO: 2733)

KEAP1_17 (#56 in Table E and present in Table P)
Sense: UGCAUCAACUGGGUCAAGU
(SEQ ID NO: 2527)
Antisense: ACUUGACCCAGUUGAUGCA
(SEQ ID NO: 2752)
```

```
SHC1_1 (#1 in Table G)
Sense: ACCUGAAAUUUGCUGGAAU
(SEQ ID NO: 3436)
Antisense: AUUCCAGCAAAUUUCAGGU
(SEQ ID NO: 3578)

SHC1_2 (#3 in Table G)
Sense: CAGAGAGCUUUUUGAUGAU
(SEQ ID NO: 3438)
Antisense: AUCAUCAAAAAGCUCUCUG
(SEQ ID NO: 3580)

SHC1_3 (#8 in Table G)
Sense: CACAUGCAAUCUAUCUCAU
(SEQ ID NO: 3443)
Antisense: AUGAGAUAGAUUGCAUGUG
(SEQ ID NO: 3585)

SHC1_6 (#28 in Table G)
Sense: CGGGAGCUUUGUCAAUAAG
(SEQ ID NO: 3463)
Antisense: CUUAUUGACAAAGCUCCCG
(SEQ ID NO: 3605)

SHC1_8 (#140 in Table G)
Sense: GGGUUCUUAUAAUGGAAAA
(SEQ ID NO: 3575)
Antisense: UUUUCCAUUAUAAGAACCC
(SEQ ID NO: 3717)

SHC1_11 (#141 in Table G)
Sense: CCCAAGCCCAAGUACAAUC
(SEQ ID NO: 3576)
Antisense: GAUUGUACUUGGGCUUGGG
(SEQ ID NO: 3718)

SHC1_14 (#142 in Table G)
Sense: AGGAAGGGCAGCUGAUGAU
(SEQ ID NO: 3577)
Antisense: AUCAUCAGCUGCCCUUCCU
(SEQ ID NO: 3719)

ZNHIT1_1 (#1 in Table I)
Sense: CCGAGGUGAUCAUUUUAAA
(SEQ ID NO: 4036)
Antisense: UUUAAAAUGAUCACCUCGG
(SEQ ID NO: 4198)

ZNHIT1_5 (#5 in Table I)
Sense: GUGACCACAUCUUUAAAAU
(SEQ ID NO: 4040)
Antisense: AUUUUAAAGAUGUGGUCAC
(SEQ ID NO: 4202)

ZNHIT1_10 (#34 in Table I)
Sense: CUGGAAAGAAAAAGAAGAA
(SEQ ID NO: 4069)
Antisense: UUCUUCUUUUUCUUUCCAG
(SEQ ID NO: 4231)

ZNHIT1_11 (#50 in Table I)
Sense: ACACUGGAAAGAAAAAGAA
(SEQ ID NO: 4085)
Antisense: UUCUUUUUCUUUCCAGUGU
(SEQ ID NO: 4247)

LGALS3_3: (#4 in Table K)
Sense: GGGAAUUUCUGGUGACAUA
(SEQ ID NO: 4713)
Antisense: UAUGUCACCAGAAAUUCCC
(SEQ ID NO: 4873)

LGALS3_5: (#159 in Table K)
Sense: GCAGACGGCUUCUCACUUA
(SEQ ID NO: 4868)
Antisense: UAAGUGAGAAGCCGUCUGC
(SEQ ID NO: 5028)

LGALS3_17 (#160 in Table K and present in Table P)
Sense: AGCGGAAAAUGGCAGACAA
(SEQ ID NO: 4869)
Antisense: UUGUCUGCCAUUUUCCGCU
(SEQ ID NO: 5029)

LGALS3_18 (#15 in Table K)
Sense: GGGUUAAAAAACUCAAUGA
(SEQ ID NO: 4724)
Antisense: UCAUUGAGUUUUUUAACCC
(SEQ ID NO: 4884)
```

It will be readily understood by those skilled in the art that the compounds of the present invention consist of a plurality of modified and/or unmodified ribonucleotides, which are linked through covalent linkages. Each such covalent linkage may be a phosphodiester linkage, a phosphorothioate linkage, or a combination of both, along the length of the ribonucleotide sequence of the individual strand. Other possible backbone modifications are described inter alia in U.S. Pat. Nos. 5,587,361; 6,242,589; 6,277,967; 6,326,358; 5,399,676; 5,489,677; 5,596,086; 6,693,187 and 7,067,641.

In particular embodiments, x and y are independently an integer between about 18 to about 40, preferably from about 19 to about 23. In a particular embodiment, x is equal to y (i.e. x=y) and in preferred embodiments x=y=19, x=y=20 or x=y=21. In a particularly preferred embodiment x=y=19.

In one embodiment of the compound of the invention, Z and Z' are both absent; in another embodiment one or both of Z or Z' is present.

In one embodiment all of the ribonucleotides of the compound are unmodified in their sugar residues.

In certain preferred embodiments at least one ribonucleotide is modified in its sugar residue, preferably by the addition of a moiety at the 2' position. A preferred moiety is selected from the group consisting of amino, fluoro, alkoxy and alkyl groups. In certain embodiments the alkozy moiety is methoxy. In a presently preferred embodiment the moiety at the 2' position is methoxy (2'-O-Me).

In preferred embodiments of the invention, alternating ribonucleotides are modified in both the antisense and the sense strands of the compound. In particular the exemplified siRNA has been modified such that a 2'-O-methyl (Me) group was present on the first, third, fifth, seventh, ninth, eleventh, thirteenth, fifteenth, seventeenth and nineteenth nucleotide of the antisense strand, whereby the very same modification, i.e. a 2'-O-Me group, was present at the second, fourth, sixth, eighth, tenth, twelfth, fourteenth, sixteenth and eighteenth nucleotide of the sense strand. Additionally, it is to be noted that these particular siRNA compounds are also blunt ended.

In various preferred embodiments the compounds of the invention comprise alternating modified and unmodified ribonucleotides in both the antisense and the sense strands of the compound. In certain embodiments in the 19-mer oligomers and 23-mer oligomers the ribonucleotides at the 5' and 3' termini of the antisense strand are modified in their sugar residues, and the ribonucleotides at the 5' and 3' termini of the sense strand are unmodified in their sugar residues. For 21-mer oligomers the ribonucleotides at the 5' and 3' termini of the sense strand are modified in their sugar residues, and the ribonucleotides at the 5' and 3' termini of the antisense strand are unmodified in their sugar residues. As mentioned above, it is preferred that the middle nucleotide of the antisense strand is unmodified.

According to one preferred embodiment of the invention, the antisense and the sense strands of the siRNA are phosphorylated only at the 3'-terminus and not at the 5'-terminus. According to another preferred embodiment of the invention, the antisense and the sense strands are non-phosphorylated. According to yet another preferred embodiment of the invention, the 5' ribonucleotide in the sense strand is modified, for example to abolish any possibility of in vivo 5'-phosphorylation.

The invention further provides a vector capable of expressing any of the aforementioned oligoribonucleotides in unmodified form in a cell after which appropriate modification may be made. In preferred embodiment the cell is a mammalian cell, preferably a human cell.

Substantially complementary refers to complementarity of greater than about 84%, to another sequence. For example in a duplex region consisting of 19 base pairs one mismatch results in 94.7% complementarity, two mismatches results in about 89.5% complementarity and 3 mismatches results in about 84.2% complementarity, rendering the duplex region substantially complementary.

Accordingly substantially identical refers to identity of greater than about 84%, to another sequence.

More particularly, the invention provides an oligoribonucleotide wherein one strand comprises consecutive nucleotides having, from 5' to 3', the sequence set forth in SEQ ID NOS:68-6815 or a homolog thereof wherein in up to two of the ribonucleotides in each terminal region is altered.

The terminal region of the oligoribonucleotide refers to bases 1-4 and/or 16-19 in the 19-mer oligomer sequence and to bases 1-4 and/or 18-21 in the 21-mer oligomer sequence.

SEQ ID NOS:68-6815 provide 19- and 21-mer oligomers useful in the preparation of siRNA compounds for targeting the expression of a gene selected from TP53; HTRA2; KEAP1; SHC1—SHC, ZNHIT1, LGALS3, and HI95 respectively. The presently most preferred compound of the invention is a blunt-ended 19-mer siRNA, i.e. x=y=19 and Z and Z' are both absent. The siRNA is either phosphorylated at 3' termini of both sense and anti-sense strands, or non-phosphorylated at all; or having the 5' most ribonucleotide on the sense strand specifically modified to abolish any possibility of in vivo 5'-phosphorylation. The alternating ribonucleotides are modified at the 2' position of the sugar residue in both the antisense and the sense strands, wherein the moiety at the 2' position is methoxy (2'-O-methyl) and wherein the ribonucleotides at the 5' and 3' termini of the antisense strand are modified in their sugar residues, and the ribonucleotides at their 5' and 3' termini of the sense strand are unmodified in their sugar residues.

The compounds of the present invention can be synthesized by any of the methods that are well known in the art for synthesis of ribonucleic (or deoxyribonucleic) oligonucleotides. Such synthesis is, among others, described in Beaucage and Iyer Tetrahedron 1992; 48: 2223-2311, Beaucage and Iyer, Tetrahedron 1993; 49: 6123-6194 and Caruthers et. al., Methods Enzymol. 1987; 154: 287-313; the synthesis of thioates is, among others, described in Eckstein, Arum. Rev. Biochem. 1985; 54: 367-402, the synthesis of RNA molecules is described in Sproat, in Humana Press 2005, Herdewijn ed.; Kap. 2: 17-31 and respective downstream processes are, among others, described in Pingoud et al., in IRL Press 1989 edited by Oliver; Kap. 7: 183-208 and Sproat (ibid).

Other synthetic procedures are known in the art e.g. the procedures as described in Usman et al., 1987, J. Am. Chem. Soc., 109, 7845; Scaringe et al., 1990, NAR, 18, 5433; Wincott et al., 1995, NAR, 23, 2677-2684; and Wincott et al., 1997, Methods Mol. Bio., 74, 59, and these procedures may make use of common nucleic acid protecting and coupling groups, such as dimethoxytrityl at the 5'-end, and phosphoramidites at the 3'-end. The modified (e.g. 2'-O-methylated) nucleotides and unmodified nucleotides are incorporated as desired.

The oligonucleotides of the present invention can be synthesized separately and joined together post-synthetically, for example, by ligation (Moore et al., 1992, Science 256, 9923; International PCT publication No, WO 93/23569; Shabarova et al., 1991, NAR 19, 4247; Bellon et al., 1997, Nucleosides & Nucleotides, 16, 951; Bellon et al., 1997, Bioconj. Chem. 8, 204), or by hybridization following synthesis and/or deprotection.

It is noted that a commercially available machine (available, inter alia, from Applied Biosystems) can be used; the oligonucleotides are prepared according to the sequences disclosed herein. Overlapping pairs of chemically synthesized fragments can be ligated using methods well known in the art (e.g., see U.S. Pat. No. 6,121,426). The strands are synthesized separately and then are annealed to each other in the tube. Then, the double-stranded siRNAs are separated from the single-stranded oligonucleotides that were not annealed (e.g. because of the excess of one of them) by HPLC. In relation to the siRNAs or siRNA fragments of the present invention, two or more such sequences can be synthesized and linked together for use in the present invention.

The compounds of the invention can also be synthesized via a tandem synthesis methodology, as described in US patent application publication No. 2004/0019001 wherein both siRNA strands are synthesized as a single contiguous oligonucleotide fragment or strand separated by a cleavable linker which is subsequently cleaved to provide separate siRNA fragments or strands that hybridize and permit purification of the siRNA duplex. The linker can be a polynucleotide linker or a non-nucleotide linker.

Pharmaceutical Compositions

While it may be possible for the compounds of the present invention to be administered as the raw chemical, it is preferable to present them as a pharmaceutical composition. Accordingly the present invention provides a pharmaceutical composition comprising one or more of the compounds of the invention; and a pharmaceutically acceptable carrier. This composition may comprise a mixture of two or more different siRNA compounds.

The invention further provides a pharmaceutical composition comprising at least one compound of the invention covalently or non-covalently bound to one or more compounds of the invention in an amount effective to inhibit the mammalian pro-apoptotic genes; and a pharmaceutically acceptable carrier. The compound may be processed intracellularly by endogenous cellular complexes to produce one or more oligoribonucleotides of the invention.

The invention further provides a pharmaceutical composition comprising a pharmaceutically acceptable carrier and one or more of the compounds of the invention in an amount effective to down-regulate expression in a cell of a mammalian pro-apoptotic gene of the present invention, the compound comprising a sequence substantially complementary to the sequence of $(N)_x$ Methods of Treatment In preferred embodiments the subject being treated is a warm-blooded animal and, in particular, mammals including human, afflicted with or suffering from a disease or disorder associated with TP53; HTRA2; KEAP1; SHC1-SHC, ZNHIT1, LGALS3, and HI95 expression.

The term "treatment" as used herein refers to administration of a therapeutic substance to a subject in need thereof in an amount effective to ameliorate symptoms associated with a disease, to lessen the severity or cure the disease, or to prevent the disease from occurring.

In cases where treatment is for the purpose of prevention, then the present invention relates to a method for delaying the onset of or averting the development of the disease or disorder.

The term "organ transplant" is meant to encompass transplant of any one or more of the following organs including, inter alia, lung, kidney, bone marrow, heart, pancreas, cornea, skin, vein, bone, cartilage, liver transplantation. Although a xenotransplant can be contemplated in certain situations, an allotransplant is usually preferable. An autograft can be considered for bone marrow, skin, bone, cartilage and or blood vessel transplantation.

For organ transplantation, either the donor or the recipient or both may be treated with a compound or composition of the present invention. Accordingly, the present invention relates to a method of treating an organ donor or an organ recipient comprising the step of administering to the organ donor or organ recipient a therapeutically effective amount of a compound according to the present invention.

The invention further relates to a method for preserving an organ comprising contacting the organ with an effective amount of compound of the present invention. Also provided is a method for reducing or preventing injury (in particular reperfusion injury) of an organ during surgery and/or following removal of the organ from a subject comprising placing the organ in an organ preserving solution wherein the solution comprises a compound according to the present invention.

Additionally, the invention provides a method of down-regulating the expression of a mammalian pro-apoptotic genes selected from the group consisting of TP53; HTRA2; KEAP1; SHC1-SHC, LGALS3, and HI95 by at least 50% as compared to a control comprising contacting a mRNA transcript selected from the group consisting of TP53 (SEQ ID NO:3); HTRA2 (SEQ ID NOS:4-5); KEAP1 (SEQ ID NOS:6-7); SHC1-SHC (SEQ ID NOS:8-9), ZNHIT1 (SEQ ID NO:10), LGALS3 (SEQ ID NOS:11-12), and HI95 (SEQ ID NO:13).; respectively with one or more of the compounds of the present invention.

In one embodiment the compound of the present invention down-regulates one of the mammalian genes selected from the group consisting of TP53; HTRA2; KEAP1; SHC1-SHC, ZNHIT1, LGALS3, and HI95 whereby the down-regulation is selected from the group comprising down-regulation of gene function, down-regulation of polypeptide and down-regulation of mRNA expression.

In one embodiment the compound is down-regulating a mammalian pro-apoptotic polypeptide, whereby the down-regulation is selected from the group comprising down-regulation of function (which may be examined by an enzymatic assay or a binding assay with a known interactor of the native gene/polypeptide, inter alia), down-regulation of protein (which may be examined by Western blotting, ELISA or immuno-precipitation, inter alia) and down-regulation of mRNA expression (which may be examined by Northern blotting, quantitative RT-PCR, in-situ hybridization or microarray hybridization, inter alia).

In additional embodiments the invention provides a method of treating a patient suffering from a disease accompanied by an elevated level of a mammalian pro-apoptotic gene disclosed herein, the method comprising administering to the patient a compound or composition of the invention in a therapeutically effective dose thereby treating the patient.

The present invention relates to the use of compounds which down-regulate the expression of a mammalian pro-apoptotic gene, particularly to novel small interfering RNAs (siRNAs), in the treatment of the following diseases or conditions in which inhibition of the expression of the mammalian TP53; HTRA2; KEAP1; SHC1-SHC, ZNHIT1, LGALS3, and HI95 genes is beneficial: acute renal failure (ARF), hearing loss including chemical-induced oxotoxicity, glaucoma, diabetic retinopathy, ischemic optic neuropathy, dry eye syndrome, acute respiratory distress syndrome (ARDS) and other acute lung and respiratory injuries, injury (e.g. ischemia-reperfusion injury) in organ transplant including lung, kidney, bone marrow, heart, pancreas, cornea or liver transplantation, nephrotoxicity, nephritis, neurotoxicity, spinal cord injury, osteoarthritis (OA), oral mucositis, pressure sores, and chronic obstructive pulmonary disease (COPD).

Other indications include chemical-induced nephrotoxicity and chemical-induced neurotoxicity, for example toxicity induced by cisplatin and cisplatin-like compounds (platinum-based compounds), by aminoglycosides, by loop diuretics, and by hydroquinone and their analogs.

Methods, molecules and compositions which inhibit a mammalian proapoptotic gene or polypeptide of the present invention are discussed herein at length, and any of said molecules and/or compositions may be beneficially employed in the treatment of a patient suffering from any of said conditions. It is to be explicitly understood that the present invention covers novel compounds and compositions as well as novel methods of treatment of known compounds (such as the compounds disclosed in co-assigned PCT Publication No. WO 2006/035434.

"Treatment" refers to both therapeutic treatment and prophylactic or preventative measures, wherein the object is to prevent or slow down (lessen) pro-apoptotic-related disorder as listed above. Those in need of treatment include those already experiencing the disease or condition, those prone to having the disease or condition, and those in which the disease or condition is to be prevented. The compounds of the invention may be administered before, during or subsequent to the onset of the disease or condition.

The method of the invention includes administering a therapeutically effective amount of one or more compounds which down-regulate expression of TP53; HTRA2; KEAP1; SHC1-SHC, ZNHIT1, LGALS3, and HI95 genes, particularly the novel siRNAs of the present invention, small molecule inhibitors of the a pro-apoptotic gene or protein or antibodies to the a pro-apoptotic proteins.

In some preferred embodiments, the methods of the invention are applied to various conditions of hearing loss. Without being bound by theory, the hearing loss may be due to inner ear hair cell damage or loss, wherein the damage or loss is caused by, inter alia, infection, mechanical injury, loud sound, aging (presbycusis or loss of hearing that gradually occurs in most individuals as they grow older), or chemical-induced ototoxicity. Ototoxins include therapeutic drugs including antineoplastic agents, salicylates, quinines, and aminoglycoside antibiotics, contaminants in foods or medicinals, and environmental or industrial pollutants. Typically, treatment is performed to prevent or reduce ototoxicity, especially resulting from or expected to result from administration of therapeutic drugs. Preferably a therapeutically effective composition is given immediately after the exposure to prevent or reduce the ototoxic effect. More preferably, treatment is provided prophylactically, either by administration of the composition prior to or concomitantly with the ototoxic pharmaceutical or the exposure to the ototoxin.

By "ototoxin" in the context of the present invention is meant a substance that through its chemical action injures, impairs or inhibits the activity of the sound receptors component of the nervous system related to hearing, which in turn impairs hearing (and/or balance). In the context of the present invention, ototoxicity includes a deleterious effect on the inner ear hair cells. Ototoxic agents that cause hearing impairments include, but are not limited to, neoplastic agents such as vincristine, vinblastine, cisplatin and cisplatin-like compounds, taxol and taxol-like compounds, dideoxy-compounds, e.g., dideoxyinosine; alcohol; metals; industrial toxins involved in occupational or environmental exposure; contaminants of food or medicinals; and over-doses of vitamins or therapeutic drugs, e.g., antibiotics such as penicillin or chloramphenicol, and megadoses of vitamins A, D, or B6, salicylates, quinines and loop diuretics.

The ototoxic effects of various therapeutic drugs on auditory cells and spiral ganglion neurons are often the limiting factor for their therapeutic usefulness. Main ototoxic drugs include the widely used chemotherapeutic agent cisplatin and its analogs, commonly used aminoglycoside antibiotics, e.g. gentamicin, for the treatment of infections caused by gram-negative bacteria, quinine and its analogs, salicylate and its analogs, and loop-diuretics.

For example, antibacterial aminoglycosides such as gentamicin, streptomycins, kanamycins, tobramycins, and the like are known to have serious toxicity, particularly ototoxicity and nephrotoxicity, which reduce the value of such antimicrobials as therapeutic agents (see Goodman and Gilman's The Pharmacological Basis of Therapeutics, 6th ed., A. Goodman Gilman et al., eds; Macmillan Publishing Co., Inc., New York, 1980, pp. 1169-71).

Clearly, ototoxicity is a dose-limiting side-effect of antibiotic administration. Studies have shown that from 4% to 15% of patients receiving 1 gram per day for greater than 1 week develop measurable hearing loss, which slowly becomes worse and can lead to complete permanent deafness if treatment continues.

Nephrotoxicity and ototoxicity are serious dose-limiting side-effect for cisplatin, a platinum coordination complex, that has proven effective on a variety of human cancers including testicular, ovarian, bladder, and head and neck cancer. Cisplatin (Platinol®) damages auditory and vestibular systems. Salicylates, such as aspirin, are the most commonly used therapeutic drugs for their anti-inflammatory, analgesic, anti-pyretic and anti-thrombotic effects. Unfortunately, they too have ototoxic side effects and can lead to tinnitus ("ringing in the ears") and temporary hearing loss. Moreover, if the drug is used at high doses for a prolonged time, chronic and irreversible hearing impairment can become an issue. Another target organ for cisplatin toxicity is the kidney. This toxicity is manifested by reduced renal function and leads to serum electrolyte changes and pathological changes in the urine analysis. Doses of cisplatin, which produce changes in renal function may cause no histopathological changes. Higher doses of the drug lead to terstitial nephritis. Cisplatin also causes bone marrow hypoplasia, and can cause autonomic neuropathy. Slight changes in liver function and histopathology are also observed following cisplatin therapy.

Without being bound by theory, it is believed that cisplatin drugs and other potentially ototoxic drugs (such as aminoglycoside antibiotics) may induce the ototoxic effects via programmed cell death or apoptosis in inner ear tissue, particularly inner ear hair cells (Zhang et al., Neuroscience 2003, 120(1):191-205; Wang et al., J. Neuroscience 2003, 23(24): 8596-8607). In mammals, auditory hair cells are produced only during embryonic development and do not regenerate if lost during postnatal life, therefore, a loss of hair cells will result in profound and irreversible deafness. Unfortunately, at present, there are no effective therapies to treat the cochlea and reverse this condition. Thus, an effective therapy to prevent cell death of auditory hair cells would be of great therapeutic value.

Another type of hearing loss is presbycusis, which is age related hearing loss. It is estimated that about 30-35 percent of adults between the ages of 65 and 75 years and about 40-50 percent of people aged 75 and older have hearing loss. Accordingly, there exists a need for means to prevent, reduce or treat the incidence and/or severity of inner ear disorders and hearing impairments involving inner ear tissue, particularly inner ear hair cells.

By "exposure to an toxic agent" is meant that the toxic agent is made available to, or comes into contact with, a mammal. A toxic agent can be toxic to one or more organs in the body, for example, the ear, kidney, nervous system, liver and the like. Exposure to a toxic agent can occur by direct administration, e.g., by ingestion or administration of a food, medicinal, or therapeutic agent, e.g., a chemotherapeutic agent, by accidental contamination, or by environmental exposure, e.g., aerial or aqueous exposure.

Hearing loss relevant to the invention may be due to end-organ lesions involving inner ear hair cells, e.g., acoustic trauma, viral endolymphatic labyrinthitis, Meniere's disease. Hearing impairments include tinnitus, which is a perception of sound in the absence of an acoustic stimulus, and may be intermittent or continuous, wherein there is diagnosed a sensorineural loss. Hearing loss may be due to bacterial or viral infection, such as in herpes zoster oticus, purulent labyrinthitis arising from acute otitis media, purulent meningitis, chronic otitis media, sudden deafness including that of viral origin, e.g., viral endolymphatic labyrinthitis caused by viruses including mumps, measles, influenza, chicken pox, mononucleosis and adenoviruses. The hearing loss can be congenital, such as that caused by rubella, anoxia during birth, bleeding into the inner ear due to trauma during delivery, ototoxic drugs administered to the mother, erythroblastosis fetalis, and hereditary conditions including Waardenburg's syndrome and Hurler's syndrome.

The hearing loss can be noise-induced, generally due to a noise greater than about 85 decibels (db) that damages the inner ear. In a particular aspect of the invention, the hearing loss is caused by an ototoxic drug that effects the auditory portion of the inner ear, particularly inner ear hair cells. Incorporated herein by reference are chapters 196, 197, 198 and 199 of The Merck Manual of Diagnosis and Therapy, 14th Edition, (1982), Merck Sharp & Dome Research Laboratories, N.J. and corresponding chapters in the most recent 16th edition, including Chapters 207 and 210) relating to description and diagnosis of hearing and balance impairments.

It is the object of the present invention to provide a method and compositions for treating a mammal, to prevent, reduce, or treat a hearing impairment, disorder or imbalance, preferably an ototoxin-induced hearing condition, by administering to a mammal in need of such treatment a composition of the invention. One embodiment of the invention is a method for treating a hearing disorder or impairment wherein the ototoxicity results from administration of a therapeutically effective amount of an ototoxic pharmaceutical drug. Typical ototoxic drugs are chemotherapeutic agents, e.g. antineoplastic agents, and antibiotics. Other possible candidates include loop-diuretics, quinines or a quinine-like compound, and salicylate or salicylate-like compounds.

Ototoxic aminoglycoside antibiotics include but are not limited to neomycin, paromomycin, ribostamycin, lividomycin, kanamycin, amikacin, tobramycin, viomycin, gentamicin, sisomicin, netilmicin, streptomycin, dibekacin, fortimicin, and dihydrostreptomycin, or combinations thereof.

Particular antibiotics include neomycin B, kanamycin A, kanamycin B, gentamicin C1, gentamicin C1a, and gentamicin C2.

Ototoxic chemotherapeutic agents amenable to the methods of the invention include, but are not limited to an antineoplastic agent, including cisplatin or cisplatin-like compounds, taxol or taxol-like compounds, and other chemotherapeutic agents believed to cause ototoxin-induced hearing impairments, e.g., vincristine, an antineoplastic drug used to treat hematological malignancies and sarcomas. Cisplatin-like compounds include, inter alia, carboplatin (Paraplatin®), tetraplatin, oxaliplatin, aroplatin and transplatin.

The methods and compositions of the present invention are also effective in the treatment of acoustic trauma or mechanical trauma, preferably acoustic or mechanical trauma that leads to inner ear hair cell loss. Acoustic trauma to be treated in the present invention may be caused by a single exposure to an extremely loud sound, or following long-term exposure to everyday loud sounds above 85 decibels. Mechanical inner ear trauma to be treated in the present invention is for example the inner ear trauma following insertion and operation of an electronic device in the inner ear. The compositions of the present invention prevent or minimize the damage to inner ear hair cells associated with the device.

In some embodiments the composition of the invention is co-administered with an ototoxin. For example, the present invention provides an improved method for treatment of infection of a mammal receiving an antibiotic for treatment of the infection, comprising administering a therapeutically effective amount of one or more compounds (particularly novel siRNAs) which down-regulate expression of the mammalian pro-apoptotic gene, to the patient in need of such treatment to reduce or prevent ototoxin-induced hearing impairment associated with the antibiotic. The compounds, which down-regulate expression of a pro-apoptotic gene are preferably administered locally within the inner ear.

In yet another embodiment an improved method for treatment of cancer in a mammal by administration of a chemotherapeutic compound is provided, wherein the improvement comprises administering a therapeutically effective amount of a composition of the invention to the patient in need of such treatment to reduce or prevent ototoxin-induced hearing impairment associated with the chemotherapeutic drug. The compounds which reduce or prevent the ototoxin-induced hearing impairment, e.g. the novel siRNAs inter alia are preferably administered locally within the inner ear.

In another embodiment the methods of treatment are applied to treatment of hearing loss resulting from the administration of a chemotherapeutic agent in order to treat its ototoxic side effect.

In another embodiment the methods of the invention are applied to hearing impairments resulting from the administration of quinine and its synthetic substitutes, typically used in the treatment of malaria, to treat its ototoxic side-effect.

In another embodiment the methods of the invention are applied to hearing impairments resulting from administration of a diuretic to treat its ototoxic side effect. Diuretics, particularly "loop" diuretics, i.e. those that act primarily in the Loop of Henle, are candidate ototoxins. Illustrative examples, not limiting to the invention method, include furosemide, ethacrylic acid, and mercurials. Diuretics are typically used to prevent or eliminate edema. Diuretics are also used in non-edematous states for example hypertension, hypercalcemia, idiopathic hypercalciuria, and nephrogenic diabetes insipidus.

In one preferred embodiment, the compounds of the invention are used for treating acute renal failure, in particular acute renal failure due to ischemia in post surgical patients, and acute renal failure due to chemotherapy treatment such as cisplatin administration or sepsis-associated acute renal failure. A preferred use of the compounds of the invention is for the prevention of acute renal failure in high-risk patients undergoing major cardiac surgery or vascular surgery. The patients at high-risk of developing acute renal failure can be identified using various scoring methods such as the Cleveland Clinic algorithm or that developed by US Academic Hospitals (QMMI) and by Veterans' Administration (CICSS). Other preferred uses of the compounds of the invention are for the prevention of ischemic acute renal failure in kidney transplant patients or for the prevention of toxic acute renal failure in patients receiving chemotherapy.

In another preferred embodiment, the siRNA compounds of the invention are used for treating acute kidney injury in patients undergoing kidney transplantation. In one embodiment, the acute kidney injury is a result of kidney ischemia-reperfusion injury during kidney transplantation.

In one preferred embodiment, the siRNA compounds of the invention for treating acute kidney injury in patients undergoing kidney transplantation are siRNA compounds directed to the TP53 gene, more preferably the siRNA compound is the 15 compound having a sense sequence set forth in SEQ ID NO:2 and an antisense sequence set forth in SEQ ID NO:1.

The siRNA compounds of the invention for treating acute kidney injury in patients undergoing kidney transplantation are preferably administered intravenously, more preferably as a single slow intravenous push.

In one preferred embodiment, the siRNA compounds of the invention are used to treat patients undergoing deceased donor kidney transplant for prophylaxis of Delayed Graft Function. Delayed Graft Function is defined as the need for dialysis within the first seven days after kidney transplantation and is associated with poorer graft function and survival. The occurrence of Delayed Graft Function is significantly higher when the graft is obtained from a donor who died from brain or cardiac death, or when the graft has been kept in cold storage conditions for more than 24 h prior to transplantation (cold storage prior to transplantation).

In order to achieve prophylaxis of Delayed Graft Function following kidney transplantation, the siRNA compounds of the invention are administered to the recipient prior to the transplantation, and/or during the transplantation, and/or following the transplantation, preferably 1 min to 24 hours following revascularization of the graft in the recipient, more preferably 15 minutes to 4 hours following revascularization of the graft in the recipient. Preferred doses of the siRNA compounds of the invention are between 0.1-50 mg/kg, more preferably between 0.5-10 mg/kg. Additionally or alternatively, the siRNA compounds of the invention are administered to a living donor preferably 24 hours or less, most preferably one hour or less prior to harvest of the organ.

For kidney transplantation, either the donor or the recipient or both may be treated with a compound or composition of the present invention. Accordingly, the present invention relates to a method of treating a kidney donor or a kidney recipient comprising the step of administering to the donor or the recipient a therapeutically effective amount of a compound according to the present invention.

The invention further relates to a method for preserving a kidney transplant or graft comprising contacting the transplant or graft with an effective amount of compound of the present invention. Also provided is a method for reducing or preventing injury (in particular reperfusion injury) of a kidney transplant or graft during surgery and/or following removal of the organ from a subject comprising placing the kidney transplant or graft in an organ preserving solution wherein the solution comprises a compound according to the present invention.

In other embodiments the compounds and methods of the invention are useful for treating or preventing the incidence or severity of various diseases and conditions in a patient, in particular conditions which are result from ischemic/reperfusion injury or oxidative stress, ischemic optic neuropathy, dry eye syndrome, acute respiratory distress syndrome (ARDS) for example due to coronavirus infection or endotoxins, severe acute respiratory syndrome (SARS), and other acute lung injuries, ischemia reperfusion injury associated with organ transplantation such as kidney or lung transplantation, glaucoma, spinal cord injury, pressure sores, oral mucositis, osteoarthritis, chronic obstructive pulmonary disease (COPD) and chemical-induced toxicity. The methods comprising administering to the patient a composition comprising one or more inhibitors (such as siRNA compounds), which inhibit TP53; HTRA2; KEAP1; SHC1-SHC, ZNHIT1, LGALS3, and HI95 in a therapeutically effective dose, thereby treating the patient.

In other embodiments the compounds and methods of the invention are useful for treating or preventing the incidence or severity of other diseases and conditions in a patient. These diseases and conditions include stroke and stroke-like situations (e.g. cerebral, renal, cardiac failure), neuronal cell death, brain injuries with or without reperfusion, chronic degenerative diseases e.g. neurodegenerative disease including Alzheimer's disease, Huntington's disease, Parkinson's disease, multiple sclerosis, amyotrophic lateral sclerosis, spinobulbar atrophy, prion disease, Sjogren's Syndrome, and apoptosis resulting from traumatic brain injury (TBI).

The compounds and methods of the invention are directed to providing neuroprotection, cerebroprotection, and to prevent and/or treat cytotoxic T cell and natural killer cell-mediated apoptosis associated with autoimmune disease and transplant rejection, and to prevent cell death of cardiac cells including heart failure, cardiomyopathy, viral infection and bacterial infection of the heart, myocardial ischemia, myocardial infarct, and myocardial ischemia, coronary artery bypass graft, and to prevent and/or treat mitochondrial drug toxicity e.g. as a result of chemotherapy or HIV therapy, to prevent cell death during viral infection or bacterial infection, and to prevent and/or treat inflammation and inflammatory diseases, inflammatory bowel disease, sepsis and septic shock. Other uses include prevention of cell death from follicle to ovocyte stages, from ovocyte to mature egg stages and sperm (for example, methods of freezing and transplanting ovarian tissue, artificial fertilization), and to preserve fertility in mammals after chemotherapy, in particular human mammals, and to prevent and/or treat, macular degeneration, and to prevent and/or treat acute hepatitis, chronic active hepatitis, hepatitis-B, and hepatitis-C, and to prevent hair loss, (e.g. hair loss due- to male-pattern baldness, and hair loss due to radiation, chemotherapy or emotional stress), and to treat or ameliorate skin damage whereby the skin damage may be due to exposure to high levels of radiation, heat, chemicals, sun, or to burns and autoimmune diseases), and to prevent cell death of bone marrow cells in myelodysplastic syndromes (MDS), and to treat pancreatitis, and to treat rheumatoid arthritis, psoriasis, glomerulonephritis, atherosclerosis, and graft versus host disease (GVHD), and to treat retinal pericyte apoptosis, retinal damages resulting from ischemia, diabetic retinopathy, and to treat any disease states associated with overexpression of a pro-apoptotic gene, wherein the expression is associated with TP53, HTRA2; KEAP1; SHC1-SHC, ZNHIT1, LGALS3, and or HI95 expression.

The TP53 siRNA compounds of the present invention are particularly useful in the treatment of glaucoma and in ameliorating or treating the adverse effects of organ transplant, including ameliorating, treating or preventing perfusion injury.

For organ transplantation, either the donor or the recipient or both may be treated with a compound or composition of the present invention. Accordingly, the present invention relates to a method of treating an organ donor or an organ recipient comprising the step of administering to the organ donor or organ recipient a therapeutically effective amount of a compound according to the present invention.

The invention further relates to a method for preserving an organ comprising contacting the organ with an effective amount of compound of the present invention. Also provided is a method for reducing or preventing injury (in particular reperfusion injury) of an organ during surgery and/or following removal of the organ from a subject comprising placing the organ in an organ preserving solution wherein the solution comprises a compound according to the present invention.

The present invention also p ides for a process of preparing a pharmaceutical composition, which comprises:
  providing one or more double stranded compound of the invention; and
  admixing said compound with a pharmaceutically acceptable carrier.

In a preferred embodiment, the compound used in the preparation of a pharmaceutical composition is admixed with a carrier in a pharmaceutically effective dose. In a particular embodiment the compound of the present invention is conjugated to a steroid or to a lipid or to another suitable molecule e.g. to cholesterol.

Delivery

The siRNA molecules of the present invention may be delivered to the target tissue by direct application of the naked molecules prepared with a carrier or a diluent.

The term "naked siRNA" refers to siRNA molecules that are substantially free from any delivery vehicle that acts to assist, promote or facilitate entry into the cell, including viral sequences, viral particles, liposome formulations, lipofectin or precipitating agents and the like. For example, siRNA in PBS is "naked siRNA".

However, in some embodiments the siRNA molecules of the invention are delivered in liposome formulations and lipofectin formulations and the like and can be prepared by methods well known to those skilled in the art. Such methods are described, for example, in U.S. Pat. Nos. 5,593,972, 5,589, 466, and 5,580,859, which are herein incorporated by reference.

Delivery systems aimed specifically at the enhanced and improved delivery of siRNA into mammalian cells have been developed (see, for example, Shen et al FEBS Let. 539: 111-114 (2003), Xia et al., Nat. Biotech. 20: 1006-1010 (2002), Reich et al., Mol. Vision. 9: 210-216 (2003), Sorensen et al., J. Mol. Biol. 327: 761-766 (2003), Lewis et al., Nat. Gen. 32: 107-108 (2002) and Simeoni et al., NAR 31, 11: 2717-2724 (2003)). siRNA has recently been successfully used for inhibition of gene expression in primates; (for details see for example, Tolentino et al., Retina 24(1):132-138).

Respiratory formulations for siRNA are described in US patent application publication No. 2004/0063654. Cholesterol-conjugated siRNAs (and other steroid and lipid conjugated siRNAs) can been used for delivery (see for example Soutschek et al Nature 2004. 432: 173-177.; and Lorenz et al. Bioorg. Med. Chem. Lett. 14:4975-4977 (2004).

Pharmaceutically acceptable carriers, solvents, diluents, excipients, adjuvants and vehicles as well as implant carriers generally refer to inert, non-toxic solid or liquid fillers, diluents or encapsulating material not reacting with the active ingredients of the invention and they include liposomes and microspheres. Examples of delivery systems useful in the present invention include U.S. Pat. Nos. 5,225,182; 5,169,383; 5,167,616; 4,959,217; 4,925,678; 4,487,603; 4,486,194; 4,447,233; 4,447,224; 4,439,196; and 4,475,196. Many other such implants, delivery systems, and modules are well known to those skilled in the art. In one specific embodiment of this invention topical and transdermal formulations may be selected. The siRNAs or pharmaceutical compositions of the present invention are administered and dosed in accordance with good medical practice, taking into account the clinical condition of the individual patient, the disease to be treated, the site and method of administration, scheduling of administration, patient age, sex, body weight and other factors known to medical practitioners. The compounds and compositions of the present invention may be administered alone or in combination with other pharmaceuticals. For example in transplant patients, it may be beneficial to co-administration of one or more compounds of the invention with an immunosuppressant, including cyclosporine, tacrolimus, azathioprine, prednisone and the like.

By "co-administration" is meant administration before, concurrently with, or after administration of an siRNA inhibitor as described above.

A "therapeutically effective dose" for purposes herein is thus determined by such considerations as are known in the art. The dose must be effective to achieve improvement including but not limited to improved survival rate or more rapid recovery, or improvement or elimination of symptoms and other indicators as are selected as appropriate measures by those skilled in the art.

In general, the active dose of compound for humans is in the range of from 1 ng/kg to about 20-100 mg/kg body weight per day, preferably about 0.01 mg to about 2-10 mg/kg body weight per day, in a regimen of one dose per day or twice or three or more times per day for a period of 1-4 weeks or longer.

The compounds of the present invention can be administered by any of the conventional routes of administration. It should be noted that the compound can be administered as the compound or as pharmaceutically acceptable salt and can be administered alone or as an active ingredient in combination with pharmaceutically acceptable carriers, solvents, diluents, excipients, adjuvants and vehicles. The compounds can be administered orally, subcutaneously or parenterally including intravenous, intraarterial, intramuscular, intraperitoneally, and intranasal administration as well as intrathecal and infusion techniques. Implants of the compounds are also useful. Liquid forms may be prepared for injection, the term including subcutaneous, transdermal, intravenous, intramuscular, intrathecal, and other parental routes of administration. The liquid compositions include aqueous solutions, with and without organic co-solvents, aqueous or oil suspensions, emulsions with edible oils, as well as similar pharmaceutical vehicles. In a particular embodiment, the administration comprises intravenous administration. In another embodiment the administration comprises topical or local administration In addition, in certain embodiments the compositions for use in the novel treatments of the present invention may be formed as aerosols, for example for intranasal administration.

The present invention further provides for a pharmaceutical composition comprising two or more siRNA molecules for the treatment of any of the diseases and conditions mentioned herein, whereby said two molecules may be physically mixed together in the pharmaceutical composition in amounts which generate equal or otherwise beneficial activity, or may be covalently or non-covalently bound, or joined together by a nucleic acid linker of a length ranging from 2-100, preferably 2-50 or 2-30 nucleotides. In one embodiment, the siRNA molecules are comprised of a double-stranded nucleic acid structure as described herein, wherein the two siRNA sequences are selected from SEQ ID NOS: 68-6815.

The siRNA molecules are covalently or non-covalently bound or joined by a linker to form a tandem siRNA molecule. Such tandem siRNA molecules comprising two siRNA sequences are typically of 38-150 nucleotides in length, more preferably 38 or 40-60 nucleotides in length, and longer accordingly if more than two siRNA sequences are included in the tandem molecule. A longer tandem molecule comprised of two or more longer sequences which encode siRNA produced via internal cellular processing, e.g., long dsRNAs, is also envisaged, as is a tandem molecule encoding two or more shRNAs. Such tandem molecules are also considered to be a part of the present invention. Particularly preferred tandem molecules are tandem molecules comprising one or two of the preferred siRNAs disclosed herein (the siRNAs, supra).

siRNA compounds that target any one of the pro-apoptotic genes disclosed herein may be the main active component in a pharmaceutical composition, or may be one active component of a pharmaceutical composition containing two or more siRNAs (or molecules which encode or endogenously produce two or more siRNAs, be it a mixture of molecules or one or more tandem molecules which encode two or more siRNAs), said pharmaceutical composition further being comprised of one or more additional siRNA molecule which targets one or more additional gene. Simultaneous inhibition of said additional gene(s) will likely have an additive or synergistic effect for treatment of the diseases disclosed herein.

Additionally, the siRNA compounds disclosed herein or any nucleic acid molecule comprising or encoding such siRNA can be linked or bound (covalently or non-covalently) to antibodies (including aptamer molecules) against cell surface internalizable molecules expressed on the target cells, in order to achieve enhanced targeting for treatment of the diseases disclosed herein. For example, anti-Fas antibody (preferably a neutralizing antibody) may be combined (covalently or non-covalently) with siRNA. In another example, an aptamer which can act like a ligand/antibody may be combined (covalently or non-covalently) with any siRNA to a pro-apoptotic gene disclosed herein.

The compounds of the present invention can be delivered either directly or with viral or non-viral vectors. When delivered directly the sequences are generally rendered nuclease resistant. Alternatively the sequences can be incorporated into expression cassettes or constructs such that the sequence is expressed in the cell as discussed herein below. Generally the construct contains the proper regulatory sequence or promoter to allow the sequence to be expressed in the targeted cell. Vectors optionally used for delivery of the compounds of the present invention are commercially available, and may be modified for the purpose of delivery of the compounds of the present invention by methods known to one of skill in the art.

It is also envisaged that a long oligonucleotide (typically 25-500 nucleotides in length) comprising one or more stem and loop structures, where stem regions comprise the sequences of the oligonucleotides of the invention, may be delivered in a carrier, preferably a pharmaceutically acceptable carrier, and may be processed intracellularly by endogenous cellular complexes (e.g. by DROSHA and DICER as described above) to produce one or more smaller double stranded oligonucleotides (siRNAs) which are oligonucleotides of the invention. This oligonucleotide can be termed a tandem shRNA construct. It is envisaged that this long oligonucleotide is a single stranded oligonucleotide comprising one or more stem and loop structures, wherein each stem region comprises a sense and corresponding antisense siRNA sequence of the pro-apoptotic genes of the invention. In particular, it is envisaged that this oligonucleotide comprises sense and antisense siRNA sequences as depicted in SEQ ID NOS:68-6815.

Although the inhibitor may be an siRNA molecule, other inhibitors contemplated to be used in the methods of the invention to inhibit expression of a pro-apoptotic gene and to treat the diseases and conditions described herein are inter alia antibodies, preferably neutralizing antibodies or fragments thereof, including single chain antibodies, antisense oligonucleotides, antisense DNA or RNA molecules, ribozymes, proteins, polypeptides and peptides including peptido-mimetics and dominant negatives, and also expression vectors expressing all the above. Additional inhibitors may be small chemical molecules, which generally have a molecular weight of less than 2000 daltons, preferably less than 1000 daltons, more preferably less than 500 daltons. These inhibitors may act as follows: small molecules may affect expression and/or activity; antibodies may affect activity; all kinds of antisense may affect gene expression; and dominant negative polypeptides and peptidomimetics may affect activity; expression vectors may be used inter alia for delivery of antisense or dominant-negative polypeptides or antibodies.

Antibodies

The term "antibody" refers to IgG, IgM, IgD, IgA, and IgE antibody, inter alia. The definition includes polyclonal antibodies or monoclonal antibodies. This term refers to whole antibodies or fragments of antibodies comprising an antigen-binding domain, e.g. antibodies without the Fc portion, single chain antibodies, miniantibodies, fragments consisting of essentially only the variable, antigen-binding domain of the antibody, etc. The term "antibody" may also refer to antibodies against polynucleotide sequences obtained by cDNA vaccination. The term also encompasses antibody fragments which retain the ability to selectively bind with their antigen or receptor and are exemplified as follows, inter alia:

(1) Fab, the fragment which contains a monovalent antigen-binding fragment of an antibody molecule which can be produced by digestion of whole antibody with the enzyme papain to yield a light chain and a portion of the heavy chain;

(Fab')$_2$, the fragment of the antibody that can be obtained by treating whole antibody with the enzyme pepsin without subsequent reduction; F(ab'$_2$) is a dimer of two Fab fragments held together by two disulfide bonds;

(3) Fv, defined as a genetically engineered fragment containing the variable region of the light chain and the variable region of the heavy chain expressed as two chains; and (4) Single chain antibody (SCA), defined as a genetically engineered molecule containing the variable region of the light chain and the variable region of the heavy chain linked by a suitable polypeptide linker as a genetically fused single chain molecule.

Antisense Molecules

By the term "antisense" (AS) or "antisense fragment" is meant a polynucleotide fragment (comprising either deoxyribonucleotides, ribonucleotides or a mixture of both) having inhibitory antisense activity, said activity causing a decrease in the expression of the endogenous genomic copy of the corresponding gene. An AS polynucleotide is a polynucleotide which comprises consecutive nucleotides having a sequence of sufficient length and homology to a sequence present within the sequence of the target gene to permit hybridization of the AS to the gene. Many reviews have covered the main aspects of antisense (AS) technology and its therapeutic potential (Aboul-Fadl T., Curr Med. Chem. 2005, 12(19):2193-214; Crooke S T, Curr Mol. Med. 2004, 4(5): 465-87; Crooke S T, Ann Rev Med. 2004, 55:61-95; Vacek M et al., Cell Mol Life Sci. 2003, 60(5):825-33; Cho-Chung Y S, Arch Pharm Res. 2003, 26(3):183-91. There are further reviews on the chemical (Crooke et al., Hematol Pathol. 1995, 9(2):59-72), cellular (Wagner, Nature. 1994, 372(6504):333-5) and therapeutic (Scanlon, et al, FASEB J. 1995, 9(13): 1288-96) aspects of AS technology. Antisense intervention in the expression of specific genes can be achieved by the use of modified AS oligonucleotide sequences (for recent reports see Lefebvre-d'Hellencourt et al, 1995; Agrawal, 1996; Lev-Lehman et al, 1997).

AS oligonucleotide sequences may be short sequences of DNA, typically 15-30 mer but may be as small as 7-mer (Wagner et al, Nat. Biotech. 1996, 14(7):840-4), designed to complement a target mRNA of interest and form an RNA:AS duplex. This duplex formation can prevent processing, splicing, transport or translation of the relevant mRNA. Moreover, certain AS nucleotide sequences can elicit cellular RNase H activity when hybridized with their target mRNA, resulting in mRNA degradation (Calabretta et al, Semin Oncol. 1996, 23(1):78-87). In that case, RNase H will cleave the RNA component of the duplex and can potentially release the AS to further hybridize with additional molecules of the target RNA. An additional mode of action results from the interaction of AS with genomic DNA to form a triple helix, which can be transcriptionally inactive.

The sequence target segment for the antisense oligonucleotide is selected such that the sequence exhibits suitable energy related characteristics important for oligonucleotide duplex formation with their complementary templates, and shows a low potential for self-dimerization or self-complementation (Anazodo et al., 1996, Biochem. Biophys. Res. Comm. 229:305-309). For example, the computer program OLIGO (Primer Analysis Software, Version 3.4), can be used to determine antisense sequence melting temperature, free energy properties, and to estimate potential self-dimer formation and self-complimentary properties. The program allows the determination of a qualitative estimation of these two parameters (potential self-dimer formation and self-complimentary) and provides an indication of "no potential" or "some potential" or "essentially complete potential". Using this program target segments are generally selected that have estimates of no potential in these parameters. However, segments can be used that have "some potential" in one of the categories. A balance of the parameters is used in the selection as is known in the art. Further, the oligonucleotides are also selected as needed so that analog substitution does not substantially affect function.

Phosphorothioate antisense oligonucleotides do not normally show significant toxicity at concentrations that are effective and exhibit sufficient pharmacodynamic half-lives in animals (Agrawal, et al., PNAS USA. 1997, 94(6):2620-5) and are nuclease resistant. Antisense oligonucleotide inhibition of basic fibroblast growth factor (bFGF), having mitogenic and angiogenic properties, suppressed 80% of growth in glioma cells (Morrison, J Biol. Chem. 1991 266(2):728-34) in a saturable and specific manner. Being hydrophobic, antisense oligonucleotides interact well with phospholipid membranes (Akhter et al., NAR. 1991, 19:5551-5559). Following their interaction with the cellular plasma membrane, they are actively (or passively) transported into living cells (Loke et al., PNAS 1989, 86(10):3474-8), in a saturable mechanism predicted to involve specific receptors (Yakubov et al., PNAS, 1989 86(17):6454-58).

Ribozymes

A "ribozyme" is an RNA molecule that possesses RNA catalytic ability (see Cech for review) and cleaves a specific site in a target RNA. In accordance with the present invention, ribozymes which cleave mRNA may be utilized as inhibitors. This may be necessary in cases where antisense therapy is limited by stoichiometric considerations (Sarver et al., 1990, Gene Regulation and Aids, pp. 305-325). Ribozymes can then be used that will target the a gene associated with a bone marrow disease. The number of RNA molecules that are cleaved by a ribozyme is greater than the number predicted by stoichiometry. (Hampel and Tritz, Biochem. 1989, 28(12): 4929-33; Uhlenbeck, Nature. 1987. 328(6131):596-600).

Ribozymes catalyze the phosphodiester bond cleavage of RNA. Several ribozyme structural families have been identified including Group I introns, RNase P, the hepatitis delta virus ribozyme, hammerhead ribozymes and the hairpin ribozyme originally derived from the negative strand of the tobacco ringspot virus satellite RNA (sTRSV) (U.S. Pat. No. 5,225,347). The latter two families are derived from viroids and virusoids, in which the ribozyme is believed to separate monomers from oligomers created during rolling circle replication (Symons, 1989 and 1992). Hammerhead and hairpin ribozyme motifs are most commonly adapted for trans-cleavage of mRNAs for gene therapy (Sullivan, 1994). In general the ribozyme has a length of from about 30-100 nucleotides. Delivery of ribozymes is similar to that of AS fragments and/or siRNA molecules.

Screening for Inhibitors of Pro-Apoptotic Gene Expression

Some of the compounds and compositions of the present invention may be used in a screening assay for identifying and isolating compounds that modulate the activity of a pro-apoptotic gene, in particular compounds that modulate a disorder accompanied by an elevated level of a pro-apoptotic gene. The compounds to be screened comprise inter alia substances such as small chemical molecules and antisense oligonucleotides.

The inhibitory activity of the compounds of the present invention on a pro-apoptotic gene or binding of the compounds of the present invention to a pro-apoptotic gene or mRNA may be used to determine the interaction of a test compound with the sequence e.g., if the test compound competes with the oligonucleotides of the present invention for inhibition of a pro-apoptotic gene, or if the additional compound rescues said inhibition. The inhibition or activation can be tested by various means, such as, inter alia, assaying for the product of the activity of a pro-apoptotic polypeptide (such as downstream polypeptides which are regulated by the pro-apoptotic polypeptide) or displacement of binding compound from the pro-apoptotic polypeptide in radioactive or fluorescent competition assays.

The present invention is illustrated in detail below with reference to Examples, but is not to be construed as being limited thereto.

Citation of any document herein is not intended as an admission that such document is pertinent prior art, or considered material to the patentability of any claim of the present application. Any statement as to content or a date of any document is based on the information available to applicant at the time of filing and does not constitute an admission as to the correctness of such a statement.

EXAMPLES

General Methods in Molecular Biology

Standard molecular biology techniques known in the art and not specifically described were generally followed as in Sambrook et al., Molecular Cloning: A Laboratory Manual, Cold Spring Harbor Laboratory Press, New York (1989), and as in Ausubel et al., Current Protocols in Molecular Biology, John Wiley and Sons, Baltimore, Md. (1989) and as in Perbal, A Practical Guide to Molecular Cloning, John Wiley & Sons, New York (1988), and as in Watson et al., Recombinant DNA, Scientific American Books, New York and in Birren et al (eds) Genome Analysis: A Laboratory Manual Series, Vols. 1-4 Cold Spring Harbor Laboratory Press, New York (1998) and methodology as set forth in U.S. Pat. Nos. 4,666,828; 4,683, 202; 4,801,531; 5,192,659 and 5,272,057 and incorporated herein by reference. Polymerase chain reaction (PCR) was carried out generally as in PCR Protocols: A Guide To Methods And Applications, Academic Press, San Diego, Calif. (1990). In situ PCR in combination with Flow Cytometry can be used for detection of cells containing specific DNA and mRNA sequences (Testoni et al., 1996, Blood 87:3822). Methods of performing RT-PCR are also well known in the art.

Example 1

In Vitro Testing of the siRNA Compounds for Pro-Apoptotic Genes

General: About $1.5-2 \times 10^5$ tested cells (HeLa cells or 293T cells for siRNA targeted the human gene and NRK52 cells or NMUMG cells for siRNA targeted the rat/mouse gene) were seeded per well in 6 wells plate (70-80% confluent).

At 24 h subsequently, cells were transfected with siRNA compounds using Lipofectamine® 2000 reagent (Invitrogene) at final concentration of 500 pM, 5 nM, 20 nM or 40 nM. The cells were incubated at 37° C. in a $CO_2$ incubator for 72 h.

As positive control for cells transfection PTEN-Cy3 labeled siRNA compounds were used. As negative control for siRNA activity GFP siRNA compounds were used.

At 72 h after transfection cells were harvested and RNA was extracted from cells. Transfection efficiency was tested by fluorescent microscopy.

Results: The percent of inhibition of gene expression using specific preferred siRNAs was determined using qPCR analysis of target gene in cells expressing the endogenous gene. The data demonstrate the percent of knockdown of the expression of the target gene in cells. In general, the siRNAs having specific sequences that were selected for in vitro testing were specific for both human and the rat/rabbit genes. Similar results of reduced expression of specific genes are obtained with other siRNAs, the sequences of which are listed in SEQ ID NOS:68-6815.

TABLE 2

Percent of knockdown of the expression of selected genes in cells using 19-mer siRNA molecules.

| SiRNA tested | SEQ ID NO | sense seq 5'>3' | SEQ ID NO | anti-sense seq 5'>3' | % of control** |
|---|---|---|---|---|---|
| HTRA2_11 | 14 | GAAUCACAGAAACACUUUU | 15 | AAAAGUGUUUCUGUGAUUC | 18, 18 |
| HTRA2_13 | 16 | CCGUGGUCUAUAUCGAGAU | 17 | AUCUCGAUAUAGACCACGG | 11, 15 |
| HTRA2_16 | 18 | GCCGUGGUCUAUAUCGAGA | 19 | UCUCGAUAUAGACCACGGC | 27 |
| HTRA2_18 | 20 | CAGCUAUUGAUUUUGGAAA | 21 | UUUCCAAAAUCAAUAGCUG | 17, 11, 15 |
| HTRA2_21 | 22 | GCUAUUGAUUUUGGAAACU | 23 | AGUUUCCAAAAUCAAUAGC | 15, 14, 9 |
| HTRA2_22 | 24 | AGCUAUUGAUUUUGGAAAC | 25 | GUUUCCAAAAUCAAUAGCU | 19, 10, 8 |
| KEAP1_2 | 26 | GCCUCAUUGAAUUCGCCUA | 27 | UAGGCGAAUUCAAUGAGGC | 18, 32 |
| KEAP1_8 | 28 | GGGCAAAAAUACAGUCCAA | 29 | UUGGACUGUAUUUUUGCCC | 18, 7 (5 nM) |
| KEAP1_9 | 30 | GGAGUAUCAUUGUUUUUGU | 31 | ACAAAAACAAUGAUACUCC | 8, 7 |
| KEAP1_10 | 32 | GGCAAAAAUACAGUCCAAU | 33 | AUUGGACUGUAUUUUUGCC | 15, 6 (5 nM) |
| KEAP1_11 | 34 | CACCAUGUGAUUUAUUCUU | 35 | AAGAAUAAAUCACAUGGUG | 24 (5 nM) |
| KEAP1_12 | 36 | ACUGCAAAUAACCCAUCUU | 37 | AAGAUGGGUUAUUUGCAGU | 38, 12 (5 nM) |
| KEAP1_13 | 38 | CACUGCAAAUAACCCAUCU | 39 | AGAUGGGUUAUUUGCAGUG | 37 |
| KEAP1_14 | 40 | GCAGCUGUCACCAUGUGAU | 41 | AUCACAUGGUGACAGCUGC | 24 |
| SHC1_1 | 42 | ACCUGAAAUUUGCUGGAAU | 43 | AUUCCAGCAAAUUUCAGGU | 16, 12 (5 nM) |
| SHC1_2 | 44 | CAGAGAGCUUUUUGAUGAU | 45 | AUCAUCAAAAAGCUCUCUG | 5, 13 |
| SHC1_3 | 46 | CACAUGCAAUCUAUCUCAU | 47 | AUGAGAUAGAUUGCAUGUG | 21, 12 |
| ZNHIT1_1 | 48 | CCGAGGUGAUCAUUUUAAA | 49 | UUUAAAAUGAUCACCUCGG | 8, 14 |
| ZNHIT1_2 | 50 | GUGACCACAUCUUUAAAAU | 51 | AUUUUAAAGAUGUGGUCAC | 22 |
| ZNHIT1_10 | 52 | CUGGAAAGAAAAAGAAGAA | 53 | UUCUUCUUUUUCUUUCCAG | 18 |
| ZNHIT1_11 | 54 | ACACUGGAAAGAAAAAGAA | 55 | UUCUUUUUCUUUCCAGUGU | 20 |
| LGALS3_12 | 56 | GUGCCUUAUAACCUGCCUU | 57 | AAGGCAGGUUAUAAGGCAC | 32, 51 |
| LGALS3_13 | 58 | GGAAGAAAGACAGUCGGUU | 59 | AACCGACUGUCUUUCUUCC | 18, 29, 27 |
| LGALS3_14 | 60 | GCAGUACAAUCAUCGGGUU | 61 | AACCCGAUGAUUGUACUGC | 26, 51 |
| LGALS3_15 | 62 | GAGAGUCAUUGUUUGCAAU | 63 | AUUGCAAACAAUGACUCUC | 24, 29, 13 |
| LGALS3_18 | 64 | GGGUUAAAAAACUCAAUGA | 65 | UCAUUGAGUUUUUUAACCC | 14, 30 |

**% of control in separate tests using 20 nM concentration of siRNA molecules (unless indicated otherwise).
All sequences are presented in a 5'-3' orientation.

Example 2

Model Systems of Acute Renal Failure (ARF)

ARF is a clinical syndrome characterized by rapid deterioration of renal function that occurs within days. Without being bound by theory the acute kidney injury may be the result of renal ischemia-reperfusion injury such as renal ischemia-reperfusion injury in patients undergoing major surgery such as major cardiac surgery. The principal feature of ARF is an abrupt decline in glomerular filtration rate (GFR), resulting in the retention of nitrogenous wastes (urea, creatinine). Recent studies support the hypothesis that apoptosis in renal tissues is prominent in most human cases of ARF. The principal site of apoptotic cell death is the distal nephron. During the initial phase of ischemic injury, loss of integrity of the actin cytoskeleton leads to flattening of the epithelium, with loss of the brush border, loss of focal cell contacts, and subsequent disengagement of the cell from the underlying substratum.

Testing the active siRNA for each pro-apoptotic gene separately for treating ARF is done using an animal model for ischemia-reperfusion-induced ARF.

Ischemia-reperfusion induced ARF: Ischemia-reperfusion injury is induced in rats following 45 minutes bilateral kidney arterial clamp and subsequent release of the clamp to allow 24 hours of reperfusion. Twelve mg/kg of siRNA of the invention (i.e. siRNA to a specific pro-apoptotic gene) are injected into the jugular vein 30 minutes prior to and 4 hours following the clamp. ARF progression is monitored by measurement of serum creatinine levels before (baseline) and 24 hrs post surgery. At the end of the experiment, the rats are perfused via an indwelling femoral line with warm PBS followed by 4% paraformaldehyde. The left kidneys are removed and stored in 4% paraformaldehyde for subsequent histological analysis. Acute renal failure is frequently defined as an acute increase of the serum creatinine level from baseline. An increase of at least 0.5 mg per dL or 44.2 μmol per L of serum creatinine is considered as an indication for acute renal failure. Serum creatinine is measured at time zero before the surgery and at 24 hours post ARF surgery. The results show that the siRNA compounds of the invention prevent onset of acute renal failure in this model.

Example 3

Model Systems of Pressure Sores or Pressure Ulcers

Pressure sores or pressure ulcers including diabetic ulcers, are areas of damaged skin and tissue that develop when sustained pressure (usually from a bed or wheelchair) cuts off circulation to vulnerable parts of the body, especially the skin on the buttocks, hips and heels. The lack of adequate blood flow leads to ischemic necrosis and ulceration of the affected tissue. Pressure sores occur most often in patients with diminished or absent sensation or who are debilitated, emaciated, paralyzed, or long bedridden. Tissues over the sacrum, ischia, greater trochanters, external malleoli, and heels are especially susceptible; other sites may be involved depending on the patient's situation.

Testing the active inhibitors of the invention (such as siRNA) for treating pressure sore, ulcers and similar wounds is performed in the mouse model described in Reid et al., Cyclical Magnetic Pressure Necrosis: J Surgical Research 2004, 116: 172-180. Additionally, rabbit models described by Mustoe et al, JCI, 1991 87(2):694-703; Ahn & Mustoe, Ann Plas Surg, 1991 24(1):17-23 are used for testing the siRNAs of the invention. The results show that the siRNA compounds treat and prevent pressure sores, ulcers and similar wounds.

Example 4

Model Systems of Chronic Obstructive Pulmonary Disease (COPD)

Chronic obstructive pulmonary disease (COPD) is characterized mainly by emphysema, which is permanent destruction of peripheral air spaces, distal to terminal bronchioles. Emphysema is also characterized by accumulation of inflammatory cells such as macrophages and neutrophils in bronchioles and alveolar structures. Emphysema and chronic bronchitis may occur as part of COPD or independently and involve apoptosis.

Testing the active inhibitors of the invention (such as siRNA) for treating COPD/emphysema/chronic bronchitis is done in the following animal models:
Cigarette smoke-induced emphysema model: chronic exposure to cigarette smoke causes emphysema in several animals such as, inter alia, mouse, guinea pig.
Lung protease activity as a trigger of emphysema.
VEGFR inhibition model of emphysema.
Bronchial instillation with human neutrophil/pancreatic elastase in rodents.
MMP (matrix metalloprotease)-induced emphysema.
Inflammation-induced emphysema.

These models and others are described in co-assigned PCT patent application WO 2006/023544, and PCT/IL2008/ 000522 which are hereby incorporated by reference into this application. The siRNA compounds of the invention prevent formation of emphysema.

Example 5

Model Systems of Spinal Cord Injury

Spinal cord injury, or myelopathy, is a disturbance of the spinal cord that results in loss of sensation and/or mobility. The two common types of spinal cord injury are due to trauma and disease. Traumatic injury can be due to automobile accidents, falls, gunshot, diving accidents inter alia, and diseases which can affect the spinal cord include polio, spina bifida, tumors and Friedreich's ataxia.
Uptake of siRNA Molecules into Neurons Following Injection into Injured Spinal-Cord:
The uptake of Cy3 labeled siRNA (delivered by injection into the injured cord) in different types of cells was examined following spinal cord contusion in 18 rats and in uninjured rats (9 rats). Sagittal cryosections were produced and immunostaining using four different groups of antibodies was performed in order to determine whether uptake has occurred in neurons, astroglia, oligdendroglia and/or macrophages/microglia. Markers for neurons were NeuN, or GAP43; markers for astroglia and potential neural stem cells were GFAP, nestin or vimentin; markers for oligdendroglia were NG2 or APC; markers for macrophages/microglia were ED1 or Iba-1 (Hasegawa et al., 2005. Exp Neurol 193 394-410).

Six rats were injected with two different doses of Cy3 labeled siRNA (1 μg/μl, 10 μg/μl) and were left for 1 and 3 days before sacrifice. Histological analyses indicate that many long filamentous profiles have taken up the labeled siRNA as well as other processes and cell bodies. Immunostaining with antibodies to MAP2 has identified uptake of label into dendrites and into cell bodies of neurons including motoneurons. Staining with other antibodies specific to astrocytes or macrophages revealed lower uptake of Cy3 labeled siRNA as compared to neurons. These results indicate that siRNA molecules injected to the injured spinal-cord reach the cell body and dendrites of neurons including motoneurons.
The Spinal-Cord Injury Animal Model:
Adult female Sprague-Dawley rats are anesthetized with 40 mg/kg of pentobarbital and the spinal thoracic T9-10 is exposed by laminectomy. Contusive injury are produced by dropping a 10 gm rod onto the exposed spinal cord from a height of 12.5 mm using MASCIS (Multicenter Animal Spinal Cord Injury Study) impactor (as described In Basso et al., Journal of Neurotrauma Vol 12 (1), p 1-21 1995 and in Basso et al., Journal of Neurotrauma Vol 13 (7), p 343-59 1996). Prior to injury, three point injections of the tested siRNA are performed at the injury epicenter 2 mm rostral and caudal to the epicenter. GFP siRNA is injected in additional five rats as a control. Each injection is conducted slowly during a period of 10 min into dorsal column (~1 mm depth) of 110 using a Hamilton syringe. Following injections, muscles and skin are closed separately. The behavioral assessment of the recovery following the spinal cord contusion is preformed using an open field locomotor test as described by Basso et al (the BBB locomotor rating scale).

Instead of using direct injection to the spinal cord, it is possible to deliver the siRNA molecules to the spinal-cord by using intrathecal delivery (such as using Alzet pump).

siRNA according to SEQ ID NOS: 68-6815 are tested in this animal model and the results show that these siRNA compounds treat and/or prevent spinal-cord injury.

Example 6

Model Systems of Glaucoma and Ischemic Optic Neuropathy

Testing the active siRNA of the invention for treating or preventing glaucoma is preformed in rat animal model for optic nerve crush described for example in: Kazumi Maeda et al., "A Novel Neuroprotectant against Retinal Ganglion Cell Damage in a Glaucoma Model and an Optic Nerve Crush Model in the Rat", Investigative Ophthalmology and visual Science (IOVS), March 2004, Vol. 45, No. 3. Specifically, for optic nerve transection the orbital optic nerve (ON) of anesthetized rats is exposed through a supraorbital approach, the meninges severed and all axons in the ON transected by crushing with forceps for 10 seconds, 2 mm from the lamina cribrosa.

siRNA compounds of the invention are tested in this animal model and the results show that these siRNA compounds treat and/or prevent glaucoma.

Other animal models for glaucoma and ischemic optic neuropathy for testing the siRNA compounds of the invention are as following:

For axotomy model: Pawel Kermer et al., "Transection of the optic nerve in rats: studying neuronal death and survival in vivo". Brain Research Protocols 7 (2001) 255-260.

For optic ischemia reperfusion model: Akitaka Tsujikawa et al., "In Vivo Evaluation of Leukocyte Dynamics in Retinal Ischemia Reperfusion Injury", Investigative Ophthalmology and visual Science (IOVS), April 1998, Vol. 39, No. 5.

For elevated intraocular pressure model: Morrison, J C et al., "A rat model of chronic pressure-induced optic nerve damage". (1997) Exp Eye Res 64,85-96.

For pharmacological ischemia reperfusion model: Koichi Masuzawa et al., "A Model of Retinal Ischemia-Reperfusion Injury in Rats by Subconjunctival Injection of Endothelin-1". Exp. Biol. Med. 2006 June; 231(6):1085-9.

Example 7

Model Systems of Ischemia Reperfusion Injury Following Lung Transplantation in Rats Lung ischemia/reperfusion injury is achieved in a rat animal model as described in Teruaki Mizobuchi et al., The Journal of Heart and Lung Transplantation, Vol 23 No. 7 (2004) and in Kazuhiro Yasufuku et al., Am. J. Respir. Cell Mol Biol, Vol 25, pp 26-34 (2001).

Specifically, after inducing anesthesia with isoflurane, the trachea is cannulated with a 14-gauge Teflon catheter and the rat is mechanically ventilated with rodent ventilator using 100% oxygen, at a rate of 70 breaths per minute and 2 cm $H_2O$ of positive end-respiratory pressure. The left pulmonary artery, veins and main stem bronchus are occluded with a Castaneda clamp. During the operation, the lung is kept moist with saline and the incision is covered to minimize evaporative losses. The period of ischemia is 60 minutes long. At the end of the ischemic period the clamp is removed and the lung is allowed to ventilate and reperfuse for further 4 h, 24 h, and 5 d post induction of lung ischemia. At the end of the experiment, the lungs are gently harvested and either frozen for RNA extraction or fixed in glutaraldehyde cocktail for subsequent histological analysis.

siRNA compounds of the invention are tested in this animal model and the results show that these siRNA compounds treat and/or prevent ischemia reperfusion injury following lung transplantation.

Example 8

Model Systems of Acute Respiratory Distress Syndrome

The active siRNA compounds of the invention are tested in an animal model for acute respiratory distress syndrome as described, for example, by Chen, et al. J Biomed Sci. 2003; 10(6 Pt 1):588-92).

The results show that these siRNA compounds can treat and/or prevent acute respiratory distress syndrome.

Example 9

Model Systems of Hearing Loss Conditions (i) Distribution of Cy3-PTEN siRNA in the Cochlea Following Local Application to the Round Window of the Ear:

A solution of 1 µg/100 µl of Cy3-PTEN siRNA (total of 0.3-0.4 µg) PBS was applied to the round window of chinchillas. The Cy3-labelled cells within the treated cochlea were analyzed 24-48 hours post siRNA round window application after sacrifice of the chinchillas. The pattern of labeling within the cochlea was similar following 24 h and 48 h and includes labeling in the basal turn of cochlea, in the middle turn of cochlea and in the apical turn of cochlea. Application of Cy3-PTEN siRNA onto scala tympani revealed labeling mainly in the basal turn of the cochlea and the middle turn of the cochlea. The Cy3 signal is persistent to up to 15 days after the application of the Cy3-PTEN siRNA. These results indicate for the first time that local application of siRNA molecules within the round window leads to significant penetration of the siRNA molecules to the basal, middle and apical turns of the cochlea. The active siRNAs of the invention are tested in this model.

(ii) Animal Model of Carboplatin-Induced or Cisplatin-Induced Hair Cell Death in the Cochlea of Chinchilla:

Chinchillas are pre-treated by direct administration of specific QM5 siRNA (sense strand: GAAGAAAAUUUCCG-CAAAA (SEQ ID NO:66); antisense strand: UUUUGCG-GAAAUUUUCUUC (SEQ ID NO:67) in saline to the left ear of each animal. Saline is given to the right ear of each animal as placebo. Two days following the administration of the specific siRNA, the animals are treated with carboplatin (75 mg/kg ip) or cisplatin (intraperitoneal infusion of 13 mg/kg over 30 minutes). After sacrifice of the chinchillas (two weeks post carboplatin treatment) the % of dead cells of inner hair cells (IHC) and outer hair cells (OHC) is calculated in the left ear (siRNA treated) and in the right ear (saline treated). The results show that the siRNA compounds prevent cell death of inner hair cells (iii) Animal Model of Acoustic-Induced Hair Cell Death in the Cochlea of Chinchilla:

The activity of specific siRNA compounds to each pro-apoptotic gene described herein in an acoustic trauma model is studied in chinchilla. The animals are exposed to an octave band of noise centered at 4 kHz for 2.5 h at 105 dB. The left ear of the noise-exposed chinchillas is pre-treated (48 h before the acoustic trauma) with 30 µg of siRNA in ~10 µL of saline; the right ear is pre-treated with vehicle (saline). The compound action potential (CAP) is a convenient and reliable electrophysiological method for measuring the neural activity transmitted from the cochlea. The CAP is recorded by placing an electrode near the base of the cochlea in order to detect the local field potential that is generated when a sound stimulus, such as click or tone burst, is abruptly turned on. The functional status of each ear is assessed 2.5 weeks after the acoustic trauma. Specifically, the mean threshold of the compound action potential recorded from the round window is determined 2.5 weeks after the acoustic trauma in order to determine if the thresholds in the siRNA-treated ear are lower (better) than the untreated (saline) ear. In addition, the amount of inner and outer hair cell loss is determined in the siRNA-treated and the control ear.

The results show that there is less cell death of inner and outer hair cells in the siRNA-treated ear than the control ear.

Example 10

Model Systems of Dry Eve

Mouse and Rat Models for Lacrimal Inflammation (Dacryoadenitis):
1. The nonobese diabetic (NOD) mouse model. Male NOD mice show significant inflammatory lesions of the lacrimal gland from the age of 8 weeks.
2. The MRL/MpJ-fas_/fas_(MRL/_) and MRL/MpJ-faslpr/faslpr (MRL/lpr) mouse models of Sjogren's syndrome (see in Jabs, D A, Enger, C, Prendergast, R A (1991) Murine models of Sjögren's syndrome: evolution of the lacrimal gland inflammatory lesions *Invest Ophthalmol Vis Sci* 32,371-380) exhibit lacrimal gland infiltrates characterized by a predominance of CD4 T cells. The extent of the lacrimal gland inflammation is significantly greater in lacrimal glands of female MRL/_and MRL/lpr mice.
3. The IQI/Jic has recently been established as a new mouse model for primary Sjogren's syndrome (see in J. Biol. Chem., Vol. 280, Issue 5, 3982-3988, Autoimmunity against a Tissue Kallikrein in IQI/Jic *Mice A MODEL FOR SJÖGREN'S SYNDROME Kensuke Takada, Mitsuyoshi Takiguchi, Akihiro Konno, and Mutsumi Inaba). The lymphocytic infiltration is well restricted to salivary and lacrimal glands.*
4. Rat model: experimental immune dacryoadenitis may be produced also in Lewis rats by sensitization with a single intradermal administration of an extract of lacrimal gland in complete Freund's adjuvant (cfa) and simultaneous intravenous injection of killed *bordetella pertussis*. (see in: Invest Ophthalmol Vis Sci. 1987 February; 28(2):276-80. Experimental autoimmune dacryoadenitis. II. Harderian gland disease in the rat. Liu S H, Sakai F, Prendergast R A, Silverstein A M).
Models for Evaporative Dry Eye:
See in: Ann N Y Acad. Sci. 2002 June; 966:211-22. Androgen deficiency, Meibomian gland dysfunction, and evaporative dry eye. Sullivan D A, Sullivan B D, Evans J E, Schirra F, Yamagami H, Liu M, Richards S M, Suzuki T, Schaumberg D A, Sullivan R M, Dana M R.

The tear film is constantly exposed to multiple environmental factors, including variable temperatures, airflow, and humidity, which may stimulate or retard its evaporation. The lipids produced by the Meibomian glands and spread onto the aqueous phase by the shear forces produced by each blink, protect the tear film from excessive evaporation. Short-term models for hyperevaporative dry eye have been created by preventing rabbits from blinking through placement of lid specula or sutures. After 2 hours of desiccation induced by lid specula, dry spots appear on the rabbit corneal epithelial surface and stain with methylene blue.

siRNA compounds of the invention are tested in the above animal model systems and the results show that these siRNA compounds treat and/or prevent dry eye symptoms.

Example 11

Model Systems for Transplantation-Associated Acute Kidney Injury

Warm Ischemia—
A left nephrectomy was performed, followed by auto transplantation that resulted in a warm kidney graft preservation period of 45 minutes. Following auto transplantation, a right nephrectomy was performed on the same animal. An anti-TP53 gene siRNA, QM5 siRNA, (sense strand: GAA-GAAAAUUUCCGCAAAA (SEQ ID NO:66); antisense strand: UUUUGCGGAAAUUUUCUUC (SEQ ID NO:67) was administered intravenously via the femoral vein either before harvesting of the kidney graft (mimicking donor treatment) ("pre"), or after the kidney autotransplantation (mimicking recipient treatment), or both before harvest and after transplantation (combined donor and recipient treatment) ("pre-post").

Cold Ischemia—
A left nephrectomy was performed on a donor animal, followed by a cold preservation (on ice) of the harvested kidney for a period of 5 hours. At the end of this period, the recipient rat underwent a bilateral nephrectomy, followed by transplantation of the cold-preserved kidney graft. The total warm ischemia time (including surgical procedure) was 30 minutes. QM5 was administered intravenously via the femoral vein, either to the donor animal prior to the kidney harvest ("pre"), or to the recipient animal 15 minutes ("post 15 min") or 4 hours (post 4 hrs) post-transplantation.

To assess the efficacy of QM5 siRNA in improvement of post-transplantation renal function, serum creatinine levels were measured on days 1, 2, and 7 post-transplantation in both warm and cold ischemia models.

In the warm ischemia experiments, serum creatinine levels in post-transplantation animals were lower in all QM5-treated groups compared to the control group, at all time points analyzed (Table 3 below); however, only at 24 hours post-transplantation were serum creatinine levels in all treatment groups statistically significantly lower than the control group. Group 3 ("post") and Group 4 ("pre-post") showed the lowest serum creatinine levels (1.11±0.68 mg/dL and 0.84±0.67 mg/dL, respectively) relative to the control group (2.36±0.99 mg/dL). No significant differences in the serum creatinine levels were found between siRNA treatment groups (adjusted p-value>0.90). These data demonstrated the ability of p53 siRNA to protect rat kidney from transplantation-related acute kidney injury associated with warm ischemia and reperfusion.

TABLE 3A

Mean serum creatinine values in warm ischemia model

| | | 24 hours | | | 48 hours | | | 168 hours | | Adjusted P-value (Tukey) | | |
|---|---|---|---|---|---|---|---|---|---|---|---|---|
| Group | N | Mean | Std | N | Mean | Std | N | Mean | Std | Pre | Pre-Post | Post |
| Control | 10 | 2.36 | 0.99 | 5 | 1.35 | 0.99 | 3 | 0.60 | 0.24 | 0.3575 | 0.1071 | 0.1890 |
| Pre Injection | 6 | 1.45 | 1.03 | 5 | 0.94 | 0.75 | 3 | 0.44 | 0.05 | | 0.9134 | 0.9654 |

TABLE 3A-continued

Mean serum creatinine values in warm ischemia model

| Group | 24 hours | | | 48 hours | | | 168 hours | | | Adjusted P-value (Tukey) | | |
|---|---|---|---|---|---|---|---|---|---|---|---|---|
| | N | Mean | Std | N | Mean | Std | N | Mean | Std | Pre | Pre-Post | Post |
| Pre-Post Injection | 7 | 0.84 | 0.67 | 4 | 0.61 | 0.17 | 3 | 0.28 | 0.05 | | | 0.9976 |
| Post Injection | 6 | 1.11 | 0.68 | 5 | 0.77 | 0.21 | 3 | 0.38 | 0.23 | | | |

An important time point is 24 hours when the acute kidney damage develops. Table 3 shows the adjusted p-values according to Tukey method for time point 24 hours.

TABLE 3B

Tukey adjusted P-value for 24 hour time point

| 24 hours | Pre Injection | Pre-Post Injection | Post Injection |
|---|---|---|---|
| Control | 0.0653 | 0.0034 | 0.0198 |
| Pre Injection | | 0.1703 | 0.4415 |
| Pre-Post Injection | | | 0.4415 |

In the cold ischemia experiments, serum creatinine levels were statistically significantly reduced in all siRNA-treated groups, at all experimental time points compared to PBS-treated control (Table 4). No significant differences were found between siRNA treatment groups themselves. Serum creatinine levels in the control animals remained elevated one week post-transplantation (mean creatinine 1.25±0.71 mg/dL), indicating the occurrence of kidney injury. QM5-treated animals demonstrated almost two-fold lower (nearly basal) serum creatinine levels one week post-transplantation (0.63±0.18; 0.64±0.17; 0.63±0.31 for "pre", "post" and "pre-post" groups, respectively), indicating the ability of QM5 to protect the kidney from DGF (delayed graft function) associated with cold and warm ischemia and subsequent reperfusion.

TABLE 4

Mean serum creatinine levels in cold ischemia model

| Group | Time N | 24 hours | | 48 hours | | 168 hours | |
|---|---|---|---|---|---|---|---|
| | | Mean | Std | Mean | | Mean | Std |
| Control | 6 | 1.88 | 0.76 | 1.45 | 1.27 | 1.25 | 0.71 |
| Pre_30 m | 6 | 1.12 | 0.32 | 0.97 | 0.39 | 0.63 | 0.18 |
| Pos_15 m | 5 | 0.92 | 0.27 | 0.70 | 0.29 | 0.64 | 0.17 |
| Post_4 h | 6 | 1.15 | 0.22 | 0.70 | 0.13 | 0.63 | 0.31 |

In conclusion, TP53-targeted siRNA protects rats from transplantation-associated acute kidney injury and from cold ischemia-associated delayed graft function. The maximum siRNA efficacy in preventing warm ischemia associated kidney dysfunction in transplantation model in rats was achieved when siRNA was administered (at a dose of 12 mg/kg) either to the recipient within hours post-transplantation, or both to donor within minutes pre harvest, and to recipient within hours post-transplantation. The difference between these two treatment regiments was not statistically significant. The maximum efficacy of QM5 in preventing cold ischemia-associated delayed graft function was achieved when siRNA was administered to the recipient as a single bolus intravenous injection (12 mg/kg) within minutes or hours post-transplantation. There was no statistically significant difference between these two treatment regiments.

For further elaboration on model systems which are used to test the compounds of the present invention, see International patent publication Nos. WO 06/023544A2, WO 2006/035434 and WO 2007/084684A2, co-assigned or assigned to the assignee of the present invention, which are hereby incorporated by reference in their entirety.

Example 12

Generation of Sequences for Active siRNA Compounds to the Pro-Apoptotic Genes and Production of the siRNAs Using proprietary algorithms and the known sequence of each pro-apoptotic gene, the sequences of potential siRNAs were generated. SEQ ID NOS:68-849 and 850-1691 set forth TP53 19-mer and 21-mer siRNAs, respectively, as 5'-3' sequences, which are prioritized based on their score in the proprietary algorithm as the best sequences for targeting the human gene expression. A list of preferred siRNA to HTRA2 is set forth in SEQ ID NOS:1692-2471. A list of preferred siRNA to KEAP1 is set forth in SEQ ID NOS:2472-3435. A list of preferred siRNA to SHC1-SHC is set forth in SEQ ID NOS:3436-4035. A list of preferred siRNA to ZNHIT1 is set forth in SEQ ID NOS:4036-4709. A list of preferred siRNA to LGALS3 is set forth in SEQ ID NOS:4710-5381. A list of preferred siRNA to HI95 is set forth in SEQ ID NOS:5382-6815.

The siRNAs used in the experiments described herein are all 19-mers, having alternating ribonucleotides modified in both the antisense and the sense strands of the compound. The modification is such that a 2'-O-methyl (Me) group is present on the first, third, fifth, seventh, ninth, eleventh, thirteenth, fifteenth, seventeenth and nineteenth nucleotide of the antisense strand, whereby the very same modification, i.e. a 2'-O-Me group, is present at the second, fourth, sixth, eighth, tenth, twelfth, fourteenth, sixteenth and eighteenth nucleotide of the sense strand. These particular siRNA compounds are also blunt ended and are non-phosphorylated at the termini; however, comparative experiments have shown that siRNA compounds phosphorylated at one or both of the 3'-termini have similar activity in vivo compared to the non-phosphorylated compounds.

It will be appreciated by a person skilled in the art that the above specific embodiments are illustrative and that the present invention is not limited by what has been particularly shown and described hereinabove. It is intended that modifications, permutations, combinations and sub-combinations fall within the true scope of this disclosure and appended claims.

SEQUENCE LISTING (7107 sequences)

SEQ ID NO: 1 - RNA, 19 nt, Artificial
  Oligomer
gagaauauuucacccuuca

SEQ ID NO: 2 - RNA, 19 nt, Artificial
  Oligomer
ugaagggugaaauauucuc

SEQ ID NO: 3 - DNA, 1182 bp, Homo sapiens
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccgcgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactga

SEQ ID NO: 4 - DNA, 1377 bp, Homo sapiens
atggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatga

SEQ ID NO: 5 - DNA, 1086 bp, Homo sapiens
atggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaagtttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatga

SEQ ID NO: 6 - DNA, 1875 bp, Homo sapiens
atgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttga

SEQ ID NO: 7 - DNA, 1875 bp, Homo sapiens; identical to SEQ ID NO: 6

SEQ ID NO: 8 - DNA, 1752 bp, Homo sapiens
atggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtga

SEQ ID NO: 9 - DNA, 1425 bp, Homo sapiens
atgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtga

SEQ ID NO: 10 - DNA, 465 bp, Homo sapiens
atggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtga

SEQ ID NO: 11 - DNA, 753 bp, Homo sapiens
atggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataa

SEQ ID NO: 12 - DNA, 1768 bp, Homo sapiens
tggcaatctagctggatagcatccctgccccttgaagagatgtttttgtggcgccacactactgacttaggcataatgcctagagatggattagaactgcacaatgaactagtggtgaggttcagtttaatggaaattggtgaaagcttttaggataaaatgataatctttgtttctttcaggaaaatggcagacaatttttcggtaagtgttttatgcctgtttcttccccttgatcagctccacatggttgagggttgggggttttgtttttaccatgactttcccttttcactctcccactgcgtggcttcccctggactcatttgtccaatgagggcttgcaagctggagccttgtttttccagcagcagatttgggaagaaagccaggcagagcgaggcctgggactcactcacagtaaccctttcaccaaaaggcccagggcggaagggagtggactctgccggcaggagctgagaaatcctctgagtagcgggaagtgcggtacagtctgggcattctgatgtttgtgattgtttttctcacggtgatgaaaaagtatgtgctataagtagaggagcgctaactcctgacttgagctaattatgaaaatgcagccctccctgatctgagacgttgggaggcaagaataaagtgaaaaagtatatgtaatcccaacatctaattttagtcttagaaactcaaactattaataagtggaaaaagtttaatgatatgcatgtaatgcctttgccatattcctctccttcttagatcacatattcctattttcctgaaaattctgcttttgagaatgctttctgtcccgtaattgtgtatgtctttctttccagctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaattacctgtctcaatatgtcaaaaaaaaaaaaaaaaaa

SEQ ID NO: 13 - DNA, 1443 bp, Homo sapiens
atgatcgtggcggactccgagtgccgcgcagagctcaaggactacctgcggttcgccccgggcggcgtcggcgactcgggccccggagaggagcagagggagagccgggctcggcgaggccctcgagggcccagcgccttcatccccgtggaggaggtccttcgggagggggctgagagcctcgagcagcacctggggctggaggcactgatgtcctctgggcgagtagacaacctggcagtggtgatgggcctgcaccctgactactttaccagcttctggcgcctgcactacctgctgctgcacacggatggtcccttggccagctcctggcgccactacattgccatcatggctgccgcccgccatcagtgttcttacctggtaggctcccacatggccgagtttctgcagactggtggtgaccctgagtggctgctgggcctccaccgggcccccgagaagctgcgcaaactcagcgagatcaacaagttgctggcgcatcggccatggctcatcaccaaggaacacatccaggccttgctgaagaccggcgagcacacttggtccctggccgagctcattcaggctctggtcctgctcacccactgccactcgctctcctccttcgtgtttggctgtggcatcctccctgagggggatgcagatggcagccctgccccccaggcacctacaccccctagtgaacagagcagccccccaagcagggacccgttgaacaactctgggggctttgagtctgcccgcgacgtggaggcgctgatggagcgcatgcagcagctgcaggagagcctgctgcgggatgaggggacgtcccaggaggagatggagagccgctttgagctggagaagtcagagagcctgctggtgaccccctcagctgacatcctggagccctctccacacccagacatgctgtgctttgtggaagaccctactttcggatatgaggacttcactcggagaggggctcaggcaccccctaccttccgggcccaggattatacctgggaagaccatggctactcgctgatccagcggctttaccctgagggtgggcagctgctggatgagaagttccaggcagcctatagcctcacctacaataccatcgccatgcacagtggtgtggacacctccgtgctccgcagggccatctggaactatatccactgcgtctttggcatcagatatgatgactatgattatggggaggtgaaccagctcctggagcggaacctcaaggtctatatcaagacagtggcctgctacccagagaagaccacccgaagaatgtacaacctcttctggaggcacttccgccactcagagaaggtccacgtgaacttgctgctcctggaggcgcgcatgcaagccgctctgctgtacgccctccgtgccatcacccgctacatgacctga

SEQ ID NO: 14 - RNA, 19 nt, Artificial
  Oligomer
gaaucacagaaacacuuuu

SEQ ID NO: 15 - RNA, 19 nt, Artificial
  Oligomer
aaaaguguuucugugauuc

SEQ ID NO: 16 - RNA, 19 nt, Artificial
  Oligomer
ccguggucuauaucgagau

SEQ ID NO: 17 - RNA, 19 nt, Artificial
  Oligomer
aucucgauauagaccacgg

SEQ ID NO: 18 - RNA, 19 nt, Artificial
  Oligomer
gccguggucuauaucgaga

SEQ ID NO: 19 - RNA, 19 nt, Artificial
  Oligomer
ucucgauauagaccacggc

SEQ ID NO: 20 - RNA, 19 nt, Artificial
  Oligomer
cagcuauugauuuuggaaa

SEQ ID NO: 21 - RNA, 19 nt, Artificial
  Oligomer
uuuccaaaaucaauagcug

SEQ ID NO: 22 - RNA, 19 nt, Artificial
  Oligomer
gcuauugauuuuggaaacu

SEQ ID NO: 23 - RNA, 19 nt, Artificial
  Oligomer
aguuuccaaaaucaauagc

SEQ ID NO: 24 - RNA, 19 nt, Artificial
  Oligomer
agcuauugauuuuggaaac

SEQ ID NO: 25 - RNA, 19 nt, Artificial
  Oligomer
guuuccaaaaucaauagcu

SEQ ID NO: 26 - RNA, 19 nt, Artificial
  Oligomer
gccucauugaauucgccua

SEQ ID NO: 27 - RNA, 19 nt, Artificial
  Oligomer
uaggcgaauucaaugaggc

SEQ ID NO: 28 - RNA, 19 nt, Artificial
  Oligomer
gggcaaaaauacaguccaa

SEQ ID NO: 29 - RNA, 19 nt, Artificial
  Oligomer
uuggacuguauuuuugccc

SEQ ID NO: 30 - RNA, 19 nt, Artificial
  Oligomer
ggaguaucauuguuuuugu

SEQ ID NO: 31 - RNA, 19 nt, Artificial
  Oligomer
acaaaaacaaugauacucc

SEQ ID NO: 32 - RNA, 19 nt, Artificial
  Oligomer
ggcaaaaauacaguccaau

SEQ ID NO: 33 - RNA, 19 nt, Artificial
  Oligomer
auuggacuguauuuuugcc

SEQ ID NO: 34 - RNA, 19 nt, Artificial
  Oligomer
caccaugugauuuauucuu

SEQ ID NO: 35 - RNA, 19 nt, Artificial
  Oligomer
aagaauaaaucacauggug

SEQ ID NO: 36 - RNA, 19 nt, Artificial
  Oligomer
acugcaaauaacccaucuu

SEQ ID NO: 37 - RNA, 19 nt, Artificial
  Oligomer
aagauggguuauuugcagu

SEQ ID NO: 38 - RNA, 19 nt, Artificial
  Oligomer
cacugcaaauaacccaucu

SEQ ID NO: 39 - RNA, 19 nt, Artificial
  Oligomer
agauggguuauuugcagug

SEQ ID NO: 40 - RNA, 19 nt, Artificial
  Oligomer
gcagcugucaccaugugau

SEQ ID NO: 41 - RNA, 19 nt, Artificial
  Oligomer
aucacauggugacagcugc

SEQ ID NO: 42 - RNA, 19 nt, Artificial
  Oligomer
accugaaauuugcuggaau

SEQ ID NO: 43 - RNA, 19 nt, Artificial
  Oligomer
auuccagcaaauuucaggu

SEQ ID NO: 44 - RNA, 19 nt, Artificial
  Oligomer
cagagagcuuuuugaugau

SEQ ID NO: 45 - RNA, 19 nt, Artificial
  Oligomer
aucaucaaaaagcucucug

SEQ ID NO: 46 - RNA, 19 nt, Artificial
  Oligomer
cacaugcaaucuaucucau

SEQ ID NO: 47 - RNA, 19 nt, Artificial
  Oligomer
augagauagauugcaugug

SEQ ID NO: 48 - RNA, 19 nt, Artificial
  Oligomer
ccgaggugaucauuuuaaa

SEQ ID NO: 49 - RNA, 19 nt, Artificial
  Oligomer
uuuaaaaugaucaccucgg

SEQ ID NO: 50 - RNA, 19 nt, Artificial
  Oligomer
gugaccacaucuuuaaaau

SEQ ID NO: 51 - RNA, 19 nt, Artificial
  Oligomer
auuuuaaagauguggucac

SEQ ID NO: 52 - RNA, 19 nt, Artificial
  Oligomer
cuggaaagaaaaagaagaa

SEQ ID NO: 53 - RNA, 19 nt, Artificial
  Oligomer
uucuucuuuuucuuuccag

SEQ ID NO: 54 - RNA, 19 nt, Artificial
  Oligomer
acacuggaaagaaaaagaa

SEQ ID NO: 55 - RNA, 19 nt, Artificial
  Oligomer
uucuuuuucuuuccagugu

SEQ ID NO: 56 - RNA, 19 nt, Artificial
  Oligomer
gugccuuauaaccugccuu

SEQ ID NO: 57 - RNA, 19 nt, Artificial
  Oligomer
aaggcagguuauaaggcac

SEQ ID NO: 58 - RNA, 19 nt, Artificial
  Oligomer
ggaagaaagacagucgguu

SEQ ID NO: 59 - RNA, 19 nt, Artificial
  Oligomer
aaccgacugucuuucuucc

SEQ ID NO: 60 - RNA, 19 nt, Artificial
  Oligomer
gcaguacaaucaucggguu

SEQ ID NO: 61 - RNA, 19 nt, Artificial
  Oligomer
aacccgaugauuguacugc

SEQ ID NO: 62 - RNA, 19 nt, Artificial
  Oligomer
gagagucauuguuugcaau

SEQ ID NO: 63 - RNA, 19 nt, Artificial
  Oligomer
auugcaaacaaugacucuc

SEQ ID NO: 64 - RNA, 19 nt, Artificial
  Oligomer
ggguuaaaaaacucaauga

SEQ ID NO: 65 - RNA, 19 nt, Artificial
  Oligomer
ucauugaguuuuuuaaccc

SEQ ID NO: 66 - RNA, 19 nt, Artificial
  Oligomer
gaagaaaauuuccgcaaaa

SEQ ID NO: 67 - RNA, 19 nt, Artificial
  Oligomer
uuuugcggaaauuuucuuc

SEQ ID NO: 68 - RNA, 19 nt, artificial
  Oligomer
gagaauauuucacccuuca

SEQ ID NO: 69 - RNA, 19 nt, artificial
  Oligomer
ccauuuuuauaucgaucuc

SEQ ID NO: 70 - RNA, 19 nt, artificial
  Oligomer
cccuuuuuauaucccauuu

SEQ ID NO: 71 - RNA, 19 nt, artificial
  Oligomer
gcccucaacaagauguuuu

SEQ ID NO: 72 - RNA, 19 nt, artificial
  Oligomer
cccauuuuuauaucgaucu

SEQ ID NO: 73 - RNA, 19 nt, artificial
  Oligomer
cagcuuagauuuuaagguu

SEQ ID NO: 74 - RNA, 19 nt, artificial
  Oligomer
ccagcuuagauuuuaaggu

SEQ ID NO: 75 - RNA, 19 nt, artificial
  Oligomer
ggaaacauuuucagaccua

SEQ ID NO: 76 - RNA, 19 nt, artificial
  Oligomer
ggaugacagaaacacuuuu

SEQ ID NO: 77 - RNA, 19 nt, artificial
  Oligomer
gccaccugaaguccaaaaa

SEQ ID NO: 78 - RNA, 19 nt, artificial
  Oligomer
gggucaacaucuuuuacau

SEQ ID NO: 79 - RNA, 19 nt, artificial
  Oligomer
cccucaacaagauguuuug

SEQ ID NO: 80 - RNA, 19 nt, artificial
  Oligomer
acauaccagcuuagauuuu

SEQ ID NO: 81 - RNA, 19 nt, artificial
  Oligomer
ucccauuuuuauaucgauc

SEQ ID NO: 82 - RNA, 19 nt, artificial
  Oligomer
ucccuuuuuauaucccauu

SEQ ID NO: 83 - RNA, 19 nt, artificial
  Oligomer
gugaggguuaaugaaauaa

SEQ ID NO: 84 - RNA, 19 nt, artificial
  Oligomer
ccauaucugugaaaugcug

SEQ ID NO: 85 - RNA, 19 nt, artificial
  Oligomer
cccauccucaccaucauca

SEQ ID NO: 86 - RNA, 19 nt, artificial
  Oligomer
ccggacgauauugaacaau

SEQ ID NO: 87 - RNA, 19 nt, artificial
  Oligomer
cccggacgauauugaacaa

SEQ ID NO: 88 - RNA, 19 nt, artificial
  Oligomer
cucuuguauaugaugaucu

SEQ ID NO: 89 - RNA, 19 nt, artificial
  Oligomer
cccucauguugaauuuucu

SEQ ID NO: 90 - RNA, 19 nt, artificial
  Oligomer
ccaccugaaguccaaaaag

SEQ ID NO: 91 - RNA, 19 nt, artificial
  Oligomer
ccaccaagacuuguuuuau

SEQ ID NO: 92 - RNA, 19 nt, artificial
  Oligomer
gcauugugaggguuaauga

SEQ ID NO: 93 - RNA, 19 nt, artificial
  Oligomer
cuaacuucaaggcccauau

SEQ ID NO: 94 - RNA, 19 nt, artificial
  Oligomer
aguuuacaaucagccacau

SEQ ID NO: 95 - RNA, 19 nt, artificial
  Oligomer
aggguuaguuuacaaucag

SEQ ID NO: 96 - RNA, 19 nt, artificial
  Oligomer
gacuuccauuugcuuuguc

SEQ ID NO: 97 - RNA, 19 nt, artificial
  Oligomer
gaaacauuuucagaccuau

SEQ ID NO: 98 - RNA, 19 nt, artificial
  Oligomer
gaaacacuuuucgacauag

SEQ ID NO: 99 - RNA, 19 nt, artificial
  Oligomer
ugcccucaacaagauguuu

SEQ ID NO: 100 - RNA, 19 nt, artificial
  Oligomer
cggacgauauugaacaaug

SEQ ID NO: 101 - RNA, 19 nt, artificial
  Oligomer
cucccuuuuuauaucccau

SEQ ID NO: 102 - RNA, 19 nt, artificial
  Oligomer
ggucaacaucuuuuacauu

SEQ ID NO: 103 - RNA, 19 nt, artificial
  Oligomer
ucuuguauaugaugaucug

SEQ ID NO: 104 - RNA, 19 nt, artificial
  Oligomer
gcugguggguugguaguuu

SEQ ID NO: 105 - RNA, 19 nt, artificial
  Oligomer
uugugaggguuaaugaaau

SEQ ID NO: 106 - RNA, 19 nt, artificial
  Oligomer
gggagauguaagaaauguu

SEQ ID NO: 107 - RNA, 19 nt, artificial
  Oligomer
cugacauucuccacuucuu

SEQ ID NO: 108 - RNA, 19 nt, artificial
  Oligomer
ccaaaaagggucagucuac

SEQ ID NO: 109 - RNA, 19 nt, artificial
  Oligomer
guaaucuacugggacggaa

SEQ ID NO: 110 - RNA, 19 nt, artificial
  Oligomer
ccauccacuacaacuacau

SEQ ID NO: 111 - RNA, 19 nt, artificial
  Oligomer
ccgaguggaaggaaauuug

SEQ ID NO: 112 - RNA, 19 nt, artificial
  Oligomer
cugucaucuucugucccuu

SEQ ID NO: 113 - RNA, 19 nt, artificial
  Oligomer
cccuccuucucccuuuuua

SEQ ID NO: 114 - RNA, 19 nt, artificial
  Oligomer
ggaagggucaacaucuuuu

SEQ ID NO: 115 - RNA, 19 nt, artificial
  Oligomer
caagacuuguuuuaugcuc

SEQ ID NO: 116 - RNA, 19 nt, artificial
  Oligomer
uccaccaagacuuguuuua

SEQ ID NO: 117 - RNA, 19 nt, artificial
  Oligomer
ggaguugucaagucuugcu

SEQ ID NO: 118 - RNA, 19 nt, artificial
  Oligomer
cccauaucugugaaaugcu

SEQ ID NO: 119 - RNA, 19 nt, artificial
  Oligomer
ggguuaguuuacaaucagc

SEQ ID NO: 120 - RNA, 19 nt, artificial
  Oligomer
acauucuccacuucuuguu

SEQ ID NO: 121 - RNA, 19 nt, artificial
  Oligomer
ccauccucaccaucaucac

SEQ ID NO: 122 - RNA, 19 nt, artificial
  Oligomer
aaacacuuuucgacauagu

SEQ ID NO: 123 - RNA, 19 nt, artificial
  Oligomer
ccugucaucuucugucccu

SEQ ID NO: 124 - RNA, 19 nt, artificial
  Oligomer
acgauauugaacaaugguu

SEQ ID NO: 125 - RNA, 19 nt, artificial
  Oligomer
ggacgauauugaacaaugg

SEQ ID NO: 126 - RNA, 19 nt, artificial
  Oligomer
acaucuuuuacauucugca

SEQ ID NO: 127 - RNA, 19 nt, artificial
  Oligomer
ccaagacuuguuuuaugcu

SEQ ID NO: 128 - RNA, 19 nt, artificial
  Oligomer
caccaagacuuguuuuaug

SEQ ID NO: 129 - RNA, 19 nt, artificial
  Oligomer
cgaccuuaguaccuaaaag

SEQ ID NO: 130 - RNA, 19 nt, artificial
  Oligomer
gguggguugguaguuucua

SEQ ID NO: 131 - RNA, 19 nt, artificial
  Oligomer
ugcauugugaggguuaaug

SEQ ID NO: 132 - RNA, 19 nt, artificial
  Oligomer
gugcauugugaggguuaau

SEQ ID NO: 133 - RNA, 19 nt, artificial
  Oligomer
gcauuugcaccuaccucac

SEQ ID NO: 134 - RNA, 19 nt, artificial
  Oligomer
ggcccauaucugugaaaug

SEQ ID NO: 135 - RNA, 19 nt, artificial
  Oligomer
aggcccauaucugugaaau

SEQ ID NO: 136 - RNA, 19 nt, artificial
  Oligomer
cucauguugaauuuucucu

SEQ ID NO: 137 - RNA, 19 nt, artificial
  Oligomer
ucccucauguugaauuuuc

SEQ ID NO: 138 - RNA, 19 nt, artificial
  Oligomer
cugucccucauguugaauu

SEQ ID NO: 139 - RNA, 19 nt, artificial
  Oligomer
agcugucccucauguugaa

SEQ ID NO: 140 - RNA, 19 nt, artificial
  Oligomer
agaccuauggaaacuacuu

SEQ ID NO: 141 - RNA, 19 nt, artificial
  Oligomer
gugagcgcuucgagauguu

SEQ ID NO: 142 - RNA, 19 nt, artificial
  Oligomer
uggaugacagaaacacuuu

SEQ ID NO: 143 - RNA, 19 nt, artificial
  Oligomer
ggaaggaaauuugcgugug

SEQ ID NO: 144 - RNA, 19 nt, artificial
  Oligomer
gcuaaaaguuuugagcuuc

SEQ ID NO: 145 - RNA, 19 nt, artificial
  Oligomer
gacuggcgcuaaaaguuuu

SEQ ID NO: 146 - RNA, 19 nt, artificial
  Oligomer
agggucaacaucuuuuaca

SEQ ID NO: 147 - RNA, 19 nt, artificial
  Oligomer
gccuugaaaccaccuuuua

SEQ ID NO: 148 - RNA, 19 nt, artificial
  Oligomer
agugcauugugaggguuaa

SEQ ID NO: 149 - RNA, 19 nt, artificial
  Oligomer
agagugcauugugaggguu

SEQ ID NO: 150 - RNA, 19 nt, artificial
  Oligomer
ugucccucauguugaauuu

SEQ ID NO: 151 - RNA, 19 nt, artificial
  Oligomer
gaccuauggaaacuacuuc

SEQ ID NO: 152 - RNA, 19 nt, artificial
  Oligomer
ggauguuugggagauguaa

SEQ ID NO: 153 - RNA, 19 nt, artificial
  Oligomer
gggauguuugggagaugua

SEQ ID NO: 154 - RNA, 19 nt, artificial
  Oligomer
aggaaacauuuucagaccu

SEQ ID NO: 155 - RNA, 19 nt, artificial
  Oligomer
uggauggagaauauuucac

SEQ ID NO: 156 - RNA, 19 nt, artificial
  Oligomer
aguauuuggaugacagaaa

SEQ ID NO: 157 - RNA, 19 nt, artificial
  Oligomer
ggaguauuuggaugacaga

SEQ ID NO: 158 - RNA, 19 nt, artificial
  Oligomer
ccugaaaacaacguucugu

SEQ ID NO: 159 - RNA, 19 nt, artificial
  Oligomer
cugguggguugguaguuuc

SEQ ID NO: 160 - RNA, 19 nt, artificial
  Oligomer
acuuccugaaaacaacguu

SEQ ID NO: 161 - RNA, 19 nt, artificial
  Oligomer
cucaagacuggcgcuaaaa

SEQ ID NO: 162 - RNA, 19 nt, artificial
  Oligomer
aucugugaaaugcuggcau

SEQ ID NO: 163 - RNA, 19 nt, artificial
  Oligomer
ucuaacuucaaggcccaua

SEQ ID NO: 164 - RNA, 19 nt, artificial
  Oligomer
gucccucauguugaauuuu

SEQ ID NO: 165 - RNA, 19 nt, artificial
  Oligomer
agaaauguucuugcaguua

SEQ ID NO: 166 - RNA, 19 nt, artificial
  Oligomer
ccauuuuggguuuuggguc

SEQ ID NO: 167 - RNA, 19 nt, artificial
  Oligomer
gacucagacugacauucuc

SEQ ID NO: 168 - RNA, 19 nt, artificial
  Oligomer
ccugacucagacugacauu

SEQ ID NO: 169 - RNA, 19 nt, artificial
  Oligomer
uuggaugacagaaacacuu

SEQ ID NO: 170 - RNA, 19 nt, artificial
  Oligomer
guggaguauuuggaugaca

SEQ ID NO: 171 - RNA, 19 nt, artificial
  Oligomer
uggcgcuaaaaguuuugag

SEQ ID NO: 172 - RNA, 19 nt, artificial
  Oligomer
agacuggcgcuaaaaguuu

SEQ ID NO: 173 - RNA, 19 nt, artificial
  Oligomer
gucgaccuuaguaccuaaa

SEQ ID NO: 174 - RNA, 19 nt, artificial
  Oligomer
cuugaaaccaccuuuuauu

SEQ ID NO: 175 - RNA, 19 nt, artificial
  Oligomer
ugcaguuaaggguuaguuu

SEQ ID NO: 176 - RNA, 19 nt, artificial
  Oligomer
uucagaccuauggaaacua

SEQ ID NO: 177 - RNA, 19 nt, artificial
  Oligomer
ccugcacugguguuuuguu

SEQ ID NO: 178 - RNA, 19 nt, artificial
  Oligomer
cauuuucagaccuauggaa

SEQ ID NO: 179 - RNA, 19 nt, artificial
  Oligomer
gacugacauucuccacuuc

SEQ ID NO: 180 - RNA, 19 nt, artificial
  Oligomer
ugacucagacugacauucu

SEQ ID NO: 181 - RNA, 19 nt, artificial
  Oligomer
cacuggauggagaauauuu

SEQ ID NO: 182 - RNA, 19 nt, artificial
  Oligomer
aaagaagaaaccacuggau

SEQ ID NO: 183 - RNA, 19 nt, artificial
  Oligomer
ucaucacacuggaagacuc

SEQ ID NO: 184 - RNA, 19 nt, artificial
  Oligomer
uggaguauuuggaugacag

SEQ ID NO: 185 - RNA, 19 nt, artificial
  Oligomer
gcguguggaguauuuggau

SEQ ID NO: 186 - RNA, 19 nt, artificial
  Oligomer
cuggcgcuaaaaguuuuga

SEQ ID NO: 187 - RNA, 19 nt, artificial
  Oligomer
ccuucucccuuuuuauauc

SEQ ID NO: 188 - RNA, 19 nt, artificial
  Oligomer
aagcaauggaugauuugau

SEQ ID NO: 189 - RNA, 19 nt, artificial
  Oligomer
agggaguugucaagucuug

SEQ ID NO: 190 - RNA, 19 nt, artificial
  Oligomer
ccuugaaaccaccuuuuau

SEQ ID NO: 191 - RNA, 19 nt, artificial
  Oligomer
gcugucccucauguugaau

SEQ ID NO: 192 - RNA, 19 nt, artificial
  Oligomer
aaauguucuugcaguuaag

SEQ ID NO: 193 - RNA, 19 nt, artificial
  Oligomer
aagaaauguucuugcaguu

SEQ ID NO: 194 - RNA, 19 nt, artificial
  Oligomer
guuugggagauguaagaaa

SEQ ID NO: 195 - RNA, 19 nt, artificial
  Oligomer
cugcacugguguuuuguug

SEQ ID NO: 196 - RNA, 19 nt, artificial
  Oligomer
cagacugacauucuccacu

SEQ ID NO: 197 - RNA, 19 nt, artificial
  Oligomer
ucaggaaacauuuucagac

SEQ ID NO: 198 - RNA, 19 nt, artificial
  Oligomer
gcugaaugaggccuuggaa

SEQ ID NO: 199 - RNA, 19 nt, artificial
  Oligomer
caaagaagaaaccacugga

SEQ ID NO: 200 - RNA, 19 nt, artificial
  Oligomer
gccaaagaagaaaccacug

SEQ ID NO: 201 - RNA, 19 nt, artificial
  Oligomer
agccaaagaagaaaccacu

SEQ ID NO: 202 - RNA, 19 nt, artificial
  Oligomer
gcucugacuguaccaccau

SEQ ID NO: 203 - RNA, 19 nt, artificial
  Oligomer
gaguauuuggaugacagaa

SEQ ID NO: 204 - RNA, 19 nt, artificial
  Oligomer
guguggaguauuuggauga

SEQ ID NO: 205 - RNA, 19 nt, artificial
  Oligomer
uggaaggaaauuugcgugu

SEQ ID NO: 206 - RNA, 19 nt, artificial
  Oligomer
cccuccucagcaucuuauc

SEQ ID NO: 207 - RNA, 19 nt, artificial
  Oligomer
acagcacaugacggagguu

SEQ ID NO: 208 - RNA, 19 nt, artificial
  Oligomer
ucgaccuuaguaccuaaaa

SEQ ID NO: 209 - RNA, 19 nt, artificial
  Oligomer
gaguugucaagucuugcug

SEQ ID NO: 210 - RNA, 19 nt, artificial
  Oligomer
cagagugcauugugagggu

SEQ ID NO: 211 - RNA, 19 nt, artificial
  Oligomer
aaggcccauaucugugaaa

SEQ ID NO: 212 - RNA, 19 nt, artificial
  Oligomer
uugcaguuaaggguuaguu

SEQ ID NO: 213 - RNA, 19 nt, artificial
  Oligomer
uucuugcaguuaaggguua

SEQ ID NO: 214 - RNA, 19 nt, artificial
  Oligomer
agggauguuugggagaugu

SEQ ID NO: 215 - RNA, 19 nt, artificial
  Oligomer
gagggauguuugggagaug

SEQ ID NO: 216 - RNA, 19 nt, artificial
  Oligomer
caggaaacauuuucagacc

SEQ ID NO: 217 - RNA, 19 nt, artificial
  Oligomer
gccauaaaaaacucauguu

SEQ ID NO: 218 - RNA, 19 nt, artificial
  Oligomer
cguguggaguauuuggaug

SEQ ID NO: 219 - RNA, 19 nt, artificial
  Oligomer
uggaugauuugaugcuguc

SEQ ID NO: 220 - RNA, 19 nt, artificial
  Oligomer
caauaaaacuuugcugcca

SEQ ID NO: 221 - RNA, 19 nt, artificial
  Oligomer
caauggaugauuugaugcu

SEQ ID NO: 222 - RNA, 19 nt, artificial
  Oligomer
gagggaguugucaagucuu

SEQ ID NO: 223 - RNA, 19 nt, artificial
  Oligomer
ugguuagguagagggaguu

SEQ ID NO: 224 - RNA, 19 nt, artificial
  Oligomer
auguacaucuggccuugaa

SEQ ID NO: 225 - RNA, 19 nt, artificial
  Oligomer
uggguuuugggucuuugaa

SEQ ID NO: 226 - RNA, 19 nt, artificial
  Oligomer
cccgccauaaaaaacucau

SEQ ID NO: 227 - RNA, 19 nt, artificial
  Oligomer
gauguuccgagagcugaau

SEQ ID NO: 228 - RNA, 19 nt, artificial
  Oligomer
agauguuccgagagcugaa

SEQ ID NO: 229 - RNA, 19 nt, artificial
  Oligomer
acauguguaacaguuccug

SEQ ID NO: 230 - RNA, 19 nt, artificial
  Oligomer
accauccacuacaacuaca

SEQ ID NO: 231 - RNA, 19 nt, artificial
  Oligomer
gagcuucucaaaagucuag

SEQ ID NO: 232 - RNA, 19 nt, artificial
  Oligomer
ucgacauagugugguggug

SEQ ID NO: 233 - RNA, 19 nt, artificial
  Oligomer
gaaggaaauuugcgugugg

SEQ ID NO: 234 - RNA, 19 nt, artificial
  Oligomer
auaauguacaucuggccuu

SEQ ID NO: 235 - RNA, 19 nt, artificial
  Oligomer
ggguuuugggucuuugaac

SEQ ID NO: 236 - RNA, 19 nt, artificial
  Oligomer
gaaguccaaaaagggucag

SEQ ID NO: 237 - RNA, 19 nt, artificial
  Oligomer
agcuucucaaaagucuaga

SEQ ID NO: 238 - RNA, 19 nt, artificial
  Oligomer
ggaaauuugcguguggagu

SEQ ID NO: 239 - RNA, 19 nt, artificial
  Oligomer
cugguuagguagagggagu

SEQ ID NO: 240 - RNA, 19 nt, artificial
  Oligomer
agccaccugaaguccaaaa

SEQ ID NO: 241 - RNA, 19 nt, artificial
  Oligomer
cagaaacacuuuucgacau

SEQ ID NO: 242 - RNA, 19 nt, artificial
  Oligomer
ugcguguggaguauuugga

SEQ ID NO: 243 - RNA, 19 nt, artificial
  Oligomer
gguagagggaguugucaag

SEQ ID NO: 244 - RNA, 19 nt, artificial
  Oligomer
gcccacuucaccguacuaa

SEQ ID NO: 245 - RNA, 19 nt, artificial
  Oligomer
ugggacggaacagcuuuga

SEQ ID NO: 246 - RNA, 19 nt, artificial
  Oligomer
gcuucuugcauucugggac

SEQ ID NO: 247 - RNA, 19 nt, artificial
  Oligomer
augcuggcauuugcaccua

SEQ ID NO: 248 - RNA, 19 nt, artificial
  Oligomer
ggaaacuacuuccugaaaa

SEQ ID NO: 249 - RNA, 19 nt, artificial
  Oligomer
ggagaauauuucacccuuc

SEQ ID NO: 250 - RNA, 19 nt, artificial
  Oligomer
agaaacacuuuucgacaua

SEQ ID NO: 251 - RNA, 19 nt, artificial
  Oligomer
caagauguuuugccaacug

SEQ ID NO: 252 - RNA, 19 nt, artificial
  Oligomer
cugcccucaacaagauguu

SEQ ID NO: 253 - RNA, 19 nt, artificial
  Oligomer
cgcuaaaaguuuugagcuu

SEQ ID NO: 254 - RNA, 19 nt, artificial
  Oligomer
ucagccacauucuagguag

SEQ ID NO: 255 - RNA, 19 nt, artificial
  Oligomer
ccaggacuuccauuugcuu

SEQ ID NO: 256 - RNA, 19 nt, artificial
  Oligomer
ccauaaaaaacucauguuc

SEQ ID NO: 257 - RNA, 19 nt, artificial
  Oligomer
uccucaccaucaucacacu

SEQ ID NO: 258 - RNA, 19 nt, artificial
  Oligomer
ccaucuacaagcagucaca

SEQ ID NO: 259 - RNA, 19 nt, artificial
  Oligomer
cucuuggucgaccuuagua

SEQ ID NO: 260 - RNA, 19 nt, artificial
  Oligomer
gccacauucuagguaggua

SEQ ID NO: 261 - RNA, 19 nt, artificial
  Oligomer
gguuuuuacugugagggau

SEQ ID NO: 262 - RNA, 19 nt, artificial
  Oligomer
cccaggacuuccauuugcu

SEQ ID NO: 263 - RNA, 19 nt, artificial
  Oligomer
cgccauaaaaaacucaugu

SEQ ID NO: 264 - RNA, 19 nt, artificial
  Oligomer
ccgccauaaaaaacucaug

SEQ ID NO: 265 - RNA, 19 nt, artificial
  Oligomer
gacagaaacacuuuucgac

SEQ ID NO: 266 - RNA, 19 nt, artificial
  Oligomer
cuggaggauuucaucucuu

SEQ ID NO: 267 - RNA, 19 nt, artificial
  Oligomer
cccugucugacaaccucuu

SEQ ID NO: 268 - RNA, 19 nt, artificial
  Oligomer
guugguaguuucuacaguu

SEQ ID NO: 269 - RNA, 19 nt, artificial
  Oligomer
gguugguaguuucuacagu

SEQ ID NO: 270 - RNA, 19 nt, artificial
  Oligomer
ggguugguaguuucuacag

SEQ ID NO: 271 - RNA, 19 nt, artificial
  Oligomer
ccacauucuagguagguag

SEQ ID NO: 272 - RNA, 19 nt, artificial
  Oligomer
guaggacauaccagcuuag

SEQ ID NO: 273 - RNA, 19 nt, artificial
  Oligomer
cccugccauuuuggguuuu

SEQ ID NO: 274 - RNA, 19 nt, artificial
  Oligomer
ucccgccauaaaaaacuca

SEQ ID NO: 275 - RNA, 19 nt, artificial
  Oligomer
cucccgccauaaaaaacuc

SEQ ID NO: 276 - RNA, 19 nt, artificial
  Oligomer
ggccuuggaacucaaggau

SEQ ID NO: 277 - RNA, 19 nt, artificial
  Oligomer
cucugagucaggaaacauu

SEQ ID NO: 278 - RNA, 19 nt, artificial
  Oligomer
uggagaauauuucacccuu

SEQ ID NO: 279 - RNA, 19 nt, artificial
  Oligomer
ccugcccucaacaagaugu

SEQ ID NO: 280 - RNA, 19 nt, artificial
  Oligomer
gaacaaugguucacugaag

SEQ ID NO: 281 - RNA, 19 nt, artificial
  Oligomer
ggcauuugcaccuaccuca

SEQ ID NO: 282 - RNA, 19 nt, artificial
  Oligomer
ugcuggcauuugcaccuac

SEQ ID NO: 283 - RNA, 19 nt, artificial
  Oligomer
ccugccauuuuggguuuug

SEQ ID NO: 284 - RNA, 19 nt, artificial
  Oligomer
gucuaccucccgccauaaa

SEQ ID NO: 285 - RNA, 19 nt, artificial
  Oligomer
ggaagagaaucuccgcaag

SEQ ID NO: 286 - RNA, 19 nt, artificial
  Oligomer
acaacuacauguguaacag

SEQ ID NO: 287 - RNA, 19 nt, artificial
  Oligomer
gccaucuacaagcagucac

SEQ ID NO: 288 - RNA, 19 nt, artificial
  Oligomer
uccuucucccuuuuuauau

SEQ ID NO: 289 - RNA, 19 nt, artificial
  Oligomer
ccuccuucucccuuuuuau

SEQ ID NO: 290 - RNA, 19 nt, artificial
  Oligomer
gccaaacccugucugacaa

SEQ ID NO: 291 - RNA, 19 nt, artificial
  Oligomer
caggacuuccauuugcuuu

SEQ ID NO: 292 - RNA, 19 nt, artificial
  Oligomer
ugaaguccaaaaaggguca

SEQ ID NO: 293 - RNA, 19 nt, artificial
  Oligomer
ugagucaggaaacauuuuc

SEQ ID NO: 294 - RNA, 19 nt, artificial
  Oligomer
gagagcugaaugaggccuu

SEQ ID NO: 295 - RNA, 19 nt, artificial
  Oligomer
agagaaucuccgcaagaaa

SEQ ID NO: 296 - RNA, 19 nt, artificial
  Oligomer
caccaucaucacacuggaa

SEQ ID NO: 297 - RNA, 19 nt, artificial
  Oligomer
cugcucagauagcgauggu

SEQ ID NO: 298 - RNA, 19 nt, artificial
  Oligomer
cuccuucucccuuuuuaua

SEQ ID NO: 299 - RNA, 19 nt, artificial
  Oligomer
ugaucuggauccaccaaga

SEQ ID NO: 300 - RNA, 19 nt, artificial
  Oligomer
cccacuucaccguacuaac

SEQ ID NO: 301 - RNA, 19 nt, artificial
  Oligomer
gccugacucagacugacau

SEQ ID NO: 302 - RNA, 19 nt, artificial
  Oligomer
cugagucaggaaacauuuu

SEQ ID NO: 303 - RNA, 19 nt, artificial
  Oligomer
aggaagagaaucuccgcaa

SEQ ID NO: 304 - RNA, 19 nt, artificial
  Oligomer
guguaacaguuccugcaug

SEQ ID NO: 305 - RNA, 19 nt, artificial
  Oligomer
aacuacauguguaacaguu

SEQ ID NO: 306 - RNA, 19 nt, artificial
  Oligomer
caacuacauguguaacagu

SEQ ID NO: 307 - RNA, 19 nt, artificial
  Oligomer
acaagauguuuugccaacu

SEQ ID NO: 308 - RNA, 19 nt, artificial
  Oligomer
cgauauugaacaaugguuc

SEQ ID NO: 309 - RNA, 19 nt, artificial
  Oligomer
guaccuaaaaggaaaucuc

SEQ ID NO: 310 - RNA, 19 nt, artificial
  Oligomer
gucccaagcaauggaugau

SEQ ID NO: 311 - RNA, 19 nt, artificial
  Oligomer
ccaccuuuuauuacauggg

SEQ ID NO: 312 - RNA, 19 nt, artificial
  Oligomer
ggccuugaaaccaccuuuu

SEQ ID NO: 313 - RNA, 19 nt, artificial
  Oligomer
ucugugaaaugcuggcauu

SEQ ID NO: 314 - RNA, 19 nt, artificial
  Oligomer
auggaaacuacuuccugaa

SEQ ID NO: 315 - RNA, 19 nt, artificial
  Oligomer
caccguacuaaccagggaa

SEQ ID NO: 316 - RNA, 19 nt, artificial
  Oligomer
aggacauaccagcuuagau

SEQ ID NO: 317 - RNA, 19 nt, artificial
  Oligomer
uggccugcacugguguuuu

SEQ ID NO: 318 - RNA, 19 nt, artificial
  Oligomer
gcuugcaauaggugugcgu

SEQ ID NO: 319 - RNA, 19 nt, artificial
  Oligomer
ccucccgccauaaaaaacu

SEQ ID NO: 320 - RNA, 19 nt, artificial
  Oligomer
cuaccucccgccauaaaaa

SEQ ID NO: 321 - RNA, 19 nt, artificial
  Oligomer
gagucaggaaacauuuuca

SEQ ID NO: 322 - RNA, 19 nt, artificial
  Oligomer
agagcugaaugaggccuug

SEQ ID NO: 323 - RNA, 19 nt, artificial
  Oligomer
ggauggagaauauuucacc

SEQ ID NO: 324 - RNA, 19 nt, artificial
  Oligomer
ccacuggauggagaauauu

SEQ ID NO: 325 - RNA, 19 nt, artificial
  Oligomer
aagagaaucuccgcaagaa

SEQ ID NO: 326 - RNA, 19 nt, artificial
  Oligomer
uccgaguggaaggaaauuu

SEQ ID NO: 327 - RNA, 19 nt, artificial
  Oligomer
caugagcgcugcucagaua

SEQ ID NO: 328 - RNA, 19 nt, artificial
  Oligomer
acaagcagucacagcacau

SEQ ID NO: 329 - RNA, 19 nt, artificial
  Oligomer
cuaaaaguuuugagcuucu

SEQ ID NO: 330 - RNA, 19 nt, artificial
  Oligomer
caacaagauguuuugccaa

SEQ ID NO: 331 - RNA, 19 nt, artificial
  Oligomer
ucaacaagauguuuugcca

SEQ ID NO: 332 - RNA, 19 nt, artificial
  Oligomer
gccaagucugugacuugca

SEQ ID NO: 333 - RNA, 19 nt, artificial
  Oligomer
guuuccgucugggcuucuu

SEQ ID NO: 334 - RNA, 19 nt, artificial
  Oligomer
acacccuggaggauuucau

SEQ ID NO: 335 - RNA, 19 nt, artificial
  Oligomer
cugugaaaugcuggcauuu

SEQ ID NO: 336 - RNA, 19 nt, artificial
  Oligomer
aggacuuccauuugcuuug

SEQ ID NO: 337 - RNA, 19 nt, artificial
  Oligomer
ucagaagcacccaggacuu

SEQ ID NO: 338 - RNA, 19 nt, artificial
  Oligomer
agaauauuucacccuucag

SEQ ID NO: 339 - RNA, 19 nt, artificial
  Oligomer
aaccacuggauggagaaua

SEQ ID NO: 340 - RNA, 19 nt, artificial
  Oligomer
ccagugguaaucuacuggg

SEQ ID NO: 341 - RNA, 19 nt, artificial
  Oligomer
cuccagugguaaucuacug

SEQ ID NO: 342 - RNA, 19 nt, artificial
  Oligomer
cuggaagacuccaguggua

SEQ ID NO: 343 - RNA, 19 nt, artificial
  Oligomer
ccaucaucacacuggaaga

SEQ ID NO: 344 - RNA, 19 nt, artificial
  Oligomer
uuauccgaguggaaggaaa

SEQ ID NO: 345 - RNA, 19 nt, artificial
  Oligomer
gcaucuuauccgaguggaa

SEQ ID NO: 346 - RNA, 19 nt, artificial
  Oligomer
caagcagucacagcacaug

SEQ ID NO: 347 - RNA, 19 nt, artificial
  Oligomer
gucugugacuugcacguac

SEQ ID NO: 348 - RNA, 19 nt, artificial
  Oligomer
ccaagucugugacuugcac

SEQ ID NO: 349 - RNA, 19 nt, artificial
  Oligomer
gcgcuaaaaguuuugagcu

SEQ ID NO: 350 - RNA, 19 nt, artificial
  Oligomer
ucugucccuucccagaaaa

SEQ ID NO: 351 - RNA, 19 nt, artificial
  Oligomer
ugaagacccagguccagau

SEQ ID NO: 352 - RNA, 19 nt, artificial
  Oligomer
acauucugcaagcacaucu

SEQ ID NO: 353 - RNA, 19 nt, artificial
  Oligomer
ucccaagcaauggaugauu

SEQ ID NO: 354 - RNA, 19 nt, artificial
  Oligomer
uggguugguaguuucuaca

SEQ ID NO: 355 - RNA, 19 nt, artificial
  Oligomer
guggguugguaguuucuac

SEQ ID NO: 356 - RNA, 19 nt, artificial
  Oligomer
uccaaaaagggucagucua

SEQ ID NO: 357 - RNA, 19 nt, artificial
  Oligomer
gcuucgagauguuccgaga

SEQ ID NO: 358 - RNA, 19 nt, artificial
  Oligomer
agaaaccacuggauggaga

SEQ ID NO: 359 - RNA, 19 nt, artificial
  Oligomer
gaagagaaucuccgcaaga

SEQ ID NO: 360 - RNA, 19 nt, artificial
  Oligomer
gaacagcuuugaggugcgu

SEQ ID NO: 361 - RNA, 19 nt, artificial
  Oligomer
cagugguaaucuacuggga

SEQ ID NO: 362 - RNA, 19 nt, artificial
  Oligomer
gaagacuccagugguaauc

SEQ ID NO: 363 - RNA, 19 nt, artificial
  Oligomer
cacuuuucgacauagugug

SEQ ID NO: 364 - RNA, 19 nt, artificial
  Oligomer
uggccaucuacaagcaguc

SEQ ID NO: 365 - RNA, 19 nt, artificial
  Oligomer
ggcgcuaaaaguuuugagc

SEQ ID NO: 366 - RNA, 19 nt, artificial
  Oligomer
agacccagguccagaugaa

SEQ ID NO: 367 - RNA, 19 nt, artificial
  Oligomer
ggauccaccaagacuuguu

SEQ ID NO: 368 - RNA, 19 nt, artificial
  Oligomer
ggaggauuucaucucuugu

SEQ ID NO: 369 - RNA, 19 nt, artificial
  Oligomer
uggaaacuacuuccugaaa

SEQ ID NO: 370 - RNA, 19 nt, artificial
  Oligomer
ccuauggaaacuacuuccu

SEQ ID NO: 371 - RNA, 19 nt, artificial
  Oligomer
ccacugaacaaguuggccu

SEQ ID NO: 372 - RNA, 19 nt, artificial
  Oligomer
ugaacccuugcuugcaaua

SEQ ID NO: 373 - RNA, 19 nt, artificial
  Oligomer
ggucuuugaacccuugcuu

SEQ ID NO: 374 - RNA, 19 nt, artificial
  Oligomer
cagcuuugaggugcguguu

SEQ ID NO: 375 - RNA, 19 nt, artificial
  Oligomer
accaucaucacacuggaag

SEQ ID NO: 376 - RNA, 19 nt, artificial
  Oligomer
ucaccaucaucacacugga

SEQ ID NO: 377 - RNA, 19 nt, artificial
  Oligomer
cacuacaacuacaugugua

SEQ ID NO: 378 - RNA, 19 nt, artificial
  Oligomer
auagugugguggugcccua

SEQ ID NO: 379 - RNA, 19 nt, artificial
  Oligomer
acagccaagucugugacuu

SEQ ID NO: 380 - RNA, 19 nt, artificial
  Oligomer
uucugucccuucccagaaa

SEQ ID NO: 381 - RNA, 19 nt, artificial
  Oligomer
ucuggauccaccaagacuu

SEQ ID NO: 382 - RNA, 19 nt, artificial
  Oligomer
cccuggaggauuucaucuc

SEQ ID NO: 383 - RNA, 19 nt, artificial
  Oligomer
cuuaguaccuaaaaggaaa

SEQ ID NO: 384 - RNA, 19 nt, artificial
  Oligomer
ggucgaccuuaguaccuaa

SEQ ID NO: 385 - RNA, 19 nt, artificial
  Oligomer
ccaaacccugucugacaac

SEQ ID NO: 386 - RNA, 19 nt, artificial
  Oligomer
cugaaaacaacguucuguc

SEQ ID NO: 387 - RNA, 19 nt, artificial
  Oligomer
ggaguaggacauaccagcu

SEQ ID NO: 388 - RNA, 19 nt, artificial
  Oligomer
ugcaauaggugugcgucag

SEQ ID NO: 389 - RNA, 19 nt, artificial
  Oligomer
ugcucaagacuggcgcuaa

SEQ ID NO: 390 - RNA, 19 nt, artificial
  Oligomer
gccauuuuggguuuugggu

SEQ ID NO: 391 - RNA, 19 nt, artificial
  Oligomer
cccucugagucaggaaaca

SEQ ID NO: 392 - RNA, 19 nt, artificial
  Oligomer
ccaaagaagaaaccacugg

SEQ ID NO: 393 - RNA, 19 nt, artificial
  Oligomer
agaaaaccuaccagggcag

SEQ ID NO: 394 - RNA, 19 nt, artificial
  Oligomer
ugaacaaugguucacugaa

SEQ ID NO: 395 - RNA, 19 nt, artificial
  Oligomer
gagcuggaagggucaacau

SEQ ID NO: 396 - RNA, 19 nt, artificial
  Oligomer
gauccaccaagacuuguuu

SEQ ID NO: 397 - RNA, 19 nt, artificial
  Oligomer
accucuuggucgaccuuag

SEQ ID NO: 398 - RNA, 19 nt, artificial
  Oligomer
accucacagagugcauugu

SEQ ID NO: 399 - RNA, 19 nt, artificial
  Oligomer
cuaccucacagagugcauu

SEQ ID NO: 400 - RNA, 19 nt, artificial
  Oligomer
guacuaaccagggaagcug

SEQ ID NO: 401 - RNA, 19 nt, artificial
  Oligomer
gggucuuugaacccuugcu

SEQ ID NO: 402 - RNA, 19 nt, artificial
  Oligomer
cucauguucaagacagaag

SEQ ID NO: 403 - RNA, 19 nt, artificial
  Oligomer
agcugaaugaggccuugga

SEQ ID NO: 404 - RNA, 19 nt, artificial
  Oligomer
acuacaacuacauguguaa

SEQ ID NO: 405 - RNA, 19 nt, artificial
  Oligomer
uggucgaccuuaguaccua

SEQ ID NO: 406 - RNA, 19 nt, artificial
  Oligomer
uggccuugaaaccaccuuu

SEQ ID NO: 407 - RNA, 19 nt, artificial
  Oligomer
cuggccuugaaaccaccuu

SEQ ID NO: 408 - RNA, 19 nt, artificial
  Oligomer
gccugcacugguguuuugu

SEQ ID NO: 409 - RNA, 19 nt, artificial
  Oligomer
ugaacaaguuggccugcac

SEQ ID NO: 410 - RNA, 19 nt, artificial
  Oligomer
acccuugcuugcaauaggu

SEQ ID NO: 411 - RNA, 19 nt, artificial
  Oligomer
ccagccaaagaagaaacca

SEQ ID NO: 412 - RNA, 19 nt, artificial
  Oligomer
cccagccaaagaagaaacc

SEQ ID NO: 413 - RNA, 19 nt, artificial
  Oligomer
agcuuugaggugcguguuu

SEQ ID NO: 414 - RNA, 19 nt, artificial
  Oligomer
ucacacuggaagacuccag

SEQ ID NO: 415 - RNA, 19 nt, artificial
  Oligomer
gcuucucaaaagucuagag

SEQ ID NO: 416 - RNA, 19 nt, artificial
  Oligomer
cucugacuguaccaccauc

SEQ ID NO: 417 - RNA, 19 nt, artificial
  Oligomer
agcaucuuauccgagugga

SEQ ID NO: 418 - RNA, 19 nt, artificial
  Oligomer
ucagcaucuuauccgagug

SEQ ID NO: 419 - RNA, 19 nt, artificial
  Oligomer
aaaguuuugagcuucucaa

SEQ ID NO: 420 - RNA, 19 nt, artificial
  Oligomer
agcagucacagcacaugac

SEQ ID NO: 421 - RNA, 19 nt, artificial
  Oligomer
ggccaucuacaagcaguca

SEQ ID NO: 422 - RNA, 19 nt, artificial
  Oligomer
gcuguggguugauuccaca

SEQ ID NO: 423 - RNA, 19 nt, artificial
  Oligomer
agcuguggguugauuccac

SEQ ID NO: 424 - RNA, 19 nt, artificial
  Oligomer
ucccuucccagaaaaccua

SEQ ID NO: 425 - RNA, 19 nt, artificial
  Oligomer
ccuaccucacagagugcau

SEQ ID NO: 426 - RNA, 19 nt, artificial
  Oligomer
accguacuaaccagggaag

SEQ ID NO: 427 - RNA, 19 nt, artificial
  Oligomer
ucaccguacuaaccaggga

SEQ ID NO: 428 - RNA, 19 nt, artificial
  Oligomer
cugaacaaguuggccugca

SEQ ID NO: 429 - RNA, 19 nt, artificial
  Oligomer
gccuuggaacucaaggaug

SEQ ID NO: 430 - RNA, 19 nt, artificial
  Oligomer
cagccaaagaagaaaccac

SEQ ID NO: 431 - RNA, 19 nt, artificial
  Oligomer
acagcuuugaggugcgugu

SEQ ID NO: 432 - RNA, 19 nt, artificial
  Oligomer
uccacuacaacuacaugug

SEQ ID NO: 433 - RNA, 19 nt, artificial
  Oligomer
ugagcuucucaaaagucua

SEQ ID NO: 434 - RNA, 19 nt, artificial
  Oligomer
cucagcaucuuauccgagu

SEQ ID NO: 435 - RNA, 19 nt, artificial
  Oligomer
caagcacaucugcauuuuc

SEQ ID NO: 436 - RNA, 19 nt, artificial
  Oligomer
ugcaagcacaucugcauuu

SEQ ID NO: 437 - RNA, 19 nt, artificial
  Oligomer
ccuuaguaccuaaaaggaa

SEQ ID NO: 438 - RNA, 19 nt, artificial
  Oligomer
uaagaaauguucuugcagu

SEQ ID NO: 439 - RNA, 19 nt, artificial
  Oligomer
cccuugcuugcaauaggug

SEQ ID NO: 440 - RNA, 19 nt, artificial
  Oligomer
guuuugagcuucucaaaag

SEQ ID NO: 441 - RNA, 19 nt, artificial
  Oligomer
uccucagcaucuuauccga

SEQ ID NO: 442 - RNA, 19 nt, artificial
  Oligomer
cucacagagugcauuguga

SEQ ID NO: 443 - RNA, 19 nt, artificial
  Oligomer
uguaagaaauguucuugca

SEQ ID NO: 444 - RNA, 19 nt, artificial
  Oligomer
ggcuccacugaacaaguug

SEQ ID NO: 445 - RNA, 19 nt, artificial
  Oligomer
ucgagauguuccgagagcu

SEQ ID NO: 446 - RNA, 19 nt, artificial
  Oligomer
caaccucuuggucgaccuu

SEQ ID NO: 447 - RNA, 19 nt, artificial
  Oligomer
uugaacccuugcuugcaau

SEQ ID NO: 448 - RNA, 19 nt, artificial
  Oligomer
uccagaugaagcucccaga

SEQ ID NO: 449 - RNA, 19 nt, artificial
  Oligomer
acaaccucuuggucgaccu

SEQ ID NO: 450 - RNA, 19 nt, artificial
  Oligomer
ggcuucuugcauucuggga

SEQ ID NO: 451 - RNA, 19 nt, artificial
  Oligomer
ucugcaagcacaucugcau

SEQ ID NO: 452 - RNA, 19 nt, artificial
  Oligomer
cugacaaccucuuggucga

SEQ ID NO: 453 - RNA, 19 nt, artificial
  Oligomer
cugcaagcacaucugcauu

SEQ ID NO: 454 - RNA, 19 nt, artificial
  Oligomer
cugggcuucuugcauucug

SEQ ID NO: 455 - RNA, 19 nt, artificial
  Oligomer
cagaaaaccuaccagggca

SEQ ID NO: 456 - RNA, 19 nt, artificial
  Oligomer
gucugggcuucuugcauuc

SEQ ID NO: 457 - RNA, 19 nt, artificial
  Oligomer
ccucugagucaggaaacau

SEQ ID NO: 458 - RNA, 19 nt, artificial
  Oligomer
aggccuuggaacucaagga

SEQ ID NO: 459 - RNA, 19 nt, artificial
  Oligomer
ugaagggugaaauauucuc

SEQ ID NO: 460 - RNA, 19 nt, artificial
  Oligomer
gagaucgauauaaaaaugg

SEQ ID NO: 461 - RNA, 19 nt, artificial
  Oligomer
aaaugggauauaaaaaggg

SEQ ID NO: 462 - RNA, 19 nt, artificial
  Oligomer
aaaacaucuuguugagggc

SEQ ID NO: 463 - RNA, 19 nt, artificial
  Oligomer
agaucgauauaaaaauggg

SEQ ID NO: 464 - RNA, 19 nt, artificial
  Oligomer
aaccuuaaaaucuaagcug

SEQ ID NO: 465 - RNA, 19 nt, artificial
  Oligomer
accuuaaaaucuaagcugg

SEQ ID NO: 466 - RNA, 19 nt, artificial
  Oligomer
uaggucugaaaauguuucc

SEQ ID NO: 467 - RNA, 19 nt, artificial
  Oligomer
aaaaguguuucugucaucc

SEQ ID NO: 468 - RNA, 19 nt, artificial
  Oligomer
uuuuuggacuucagguggc

SEQ ID NO: 469 - RNA, 19 nt, artificial
  Oligomer
auguaaaagauguugaccc

SEQ ID NO: 470 - RNA, 19 nt, artificial
  Oligomer
caaaacaucuuguugaggg

SEQ ID NO: 471 - RNA, 19 nt, artificial
  Oligomer
aaaaucuaagcugguaugu

SEQ ID NO: 472 - RNA, 19 nt, artificial
  Oligomer
gaucgauauaaaaauggga

SEQ ID NO: 473 - RNA, 19 nt, artificial
  Oligomer
aaugggauauaaaaaggga

SEQ ID NO: 474 - RNA, 19 nt, artificial
  Oligomer
uuauuucauuaacccucac

SEQ ID NO: 475 - RNA, 19 nt, artificial
  Oligomer
cagcauuucacagauaugg

SEQ ID NO: 476 - RNA, 19 nt, artificial
  Oligomer
ugaugauggugaggauggg

SEQ ID NO: 477 - RNA, 19 nt, artificial
  Oligomer
auuguucaauaucguccgg

SEQ ID NO: 478 - RNA, 19 nt, artificial
  Oligomer
uuguucaauaucguccggg

SEQ ID NO: 479 - RNA, 19 nt, artificial
  Oligomer
agaucaucauauacaagag

SEQ ID NO: 480 - RNA, 19 nt, artificial
  Oligomer
agaaaauucaacaugaggg

SEQ ID NO: 481 - RNA, 19 nt, artificial
  Oligomer
cuuuuuggacuucaggugg

SEQ ID NO: 482 - RNA, 19 nt, artificial
  Oligomer
auaaaacaagucuuggugg

SEQ ID NO: 483 - RNA, 19 nt, artificial
  Oligomer
ucauuaacccucacaaugc

SEQ ID NO: 484 - RNA, 19 nt, artificial
  Oligomer
auaugggccuugaaguuag

SEQ ID NO: 485 - RNA, 19 nt, artificial
  Oligomer
auguggcugauuguaaacu

SEQ ID NO: 486 - RNA, 19 nt, artificial
  Oligomer
cugauuguaaacuaacccu

SEQ ID NO: 487 - RNA, 19 nt, artificial
  Oligomer
gacaaagcaaauggaaguc

SEQ ID NO: 488 - RNA, 19 nt, artificial
  Oligomer
auaggucugaaaauguuuc

SEQ ID NO: 489 - RNA, 19 nt, artificial
  Oligomer
cuaugucgaaaaguguuuc

SEQ ID NO: 490 - RNA, 19 nt, artificial
  Oligomer
aaacaucuuguugagggca

SEQ ID NO: 491 - RNA, 19 nt, artificial
  Oligomer
cauuguucaauaucguccg

SEQ ID NO: 492 - RNA, 19 nt, artificial
  Oligomer
augggauauaaaaagggag

SEQ ID NO: 493 - RNA, 19 nt, artificial
  Oligomer
aauguaaaagauguugacc

SEQ ID NO: 494 - RNA, 19 nt, artificial
  Oligomer
cagaucaucauauacaaga

SEQ ID NO: 495 - RNA, 19 nt, artificial
  Oligomer
aaacuaccaacccaccagc

SEQ ID NO: 496 - RNA, 19 nt, artificial
  Oligomer
auuucauuaacccucacaa

SEQ ID NO: 497 - RNA, 19 nt, artificial
  Oligomer
aacauuucuuacaucuccc

SEQ ID NO: 498 - RNA, 19 nt, artificial
  Oligomer
aagaaguggagaaugucag

SEQ ID NO: 499 - RNA, 19 nt, artificial
  Oligomer
guagacugacccuuuuugg

SEQ ID NO: 500 - RNA, 19 nt, artificial
  Oligomer
uuccgucccaguagauuac

SEQ ID NO: 501 - RNA, 19 nt, artificial
  Oligomer
auguaguuguaguggaugg

SEQ ID NO: 502 - RNA, 19 nt, artificial
  Oligomer
caaauuuccuuccacucgg

SEQ ID NO: 503 - RNA, 19 nt, artificial
  Oligomer
aagggacagaagaugacag

SEQ ID NO: 504 - RNA, 19 nt, artificial
  Oligomer
uaaaaagggagaaggaggg

SEQ ID NO: 505 - RNA, 19 nt, artificial
  Oligomer
aaaagauguugacccuucc

SEQ ID NO: 506 - RNA, 19 nt, artificial
  Oligomer
gagcauaaaacaagucuug

SEQ ID NO: 507 - RNA, 19 nt, artificial
  Oligomer
uaaaacaagucuuggugga

SEQ ID NO: 508 - RNA, 19 nt, artificial
  Oligomer
agcaagacuugacaacucc

SEQ ID NO: 509 - RNA, 19 nt, artificial
  Oligomer
agcauuucacagauauggg

SEQ ID NO: 510 - RNA, 19 nt, artificial
  Oligomer
gcugauuguaaacuaaccc

SEQ ID NO: 511 - RNA, 19 nt, artificial
  Oligomer
aacaagaaguggagaaugu

SEQ ID NO: 512 - RNA, 19 nt, artificial
  Oligomer
gugaugauggugaggaugg

SEQ ID NO: 513 - RNA, 19 nt, artificial
  Oligomer
acuaugucgaaaaguguuu

SEQ ID NO: 514 - RNA, 19 nt, artificial
  Oligomer
agggacagaagaugacagg

SEQ ID NO: 515 - RNA, 19 nt, artificial
  Oligomer
aaccauuguucaauaucgu

SEQ ID NO: 516 - RNA, 19 nt, artificial
  Oligomer
ccauuguucaauaucgucc

SEQ ID NO: 517 - RNA, 19 nt, artificial
  Oligomer
ugcagaauguaaaagaugu

SEQ ID NO: 518 - RNA, 19 nt, artificial
  Oligomer
agcauaaaacaagucuugg

SEQ ID NO: 519 - RNA, 19 nt, artificial
  Oligomer
cauaaaacaagucuuggug

SEQ ID NO: 520 - RNA, 19 nt, artificial
  Oligomer
cuuuuagguacuaaggucg

SEQ ID NO: 521 - RNA, 19 nt, artificial
  Oligomer
uagaaacuaccaacccacc

SEQ ID NO: 522 - RNA, 19 nt, artificial
  Oligomer
cauuaacccucacaaugca

SEQ ID NO: 523 - RNA, 19 nt, artificial
  Oligomer
auuaacccucacaaugcac

SEQ ID NO: 524 - RNA, 19 nt, artificial
  Oligomer
gugagguaggugcaaaugc

SEQ ID NO: 525 - RNA, 19 nt, artificial
  Oligomer
cauuucacagauaugggcc

SEQ ID NO: 526 - RNA, 19 nt, artificial
  Oligomer
auuucacagauaugggccu

SEQ ID NO: 527 - RNA, 19 nt, artificial
  Oligomer
agagaaaauucaacaugag

SEQ ID NO: 528 - RNA, 19 nt, artificial
  Oligomer
gaaaauucaacaugaggga

SEQ ID NO: 529 - RNA, 19 nt, artificial
  Oligomer
aauucaacaugagggacag

SEQ ID NO: 530 - RNA, 19 nt, artificial
  Oligomer
uucaacaugagggacagcu

SEQ ID NO: 531 - RNA, 19 nt, artificial
  Oligomer
aaguaguuuccauaggucu

SEQ ID NO: 532 - RNA, 19 nt, artificial
  Oligomer
aacaucucgaagcgcucac

SEQ ID NO: 533 - RNA, 19 nt, artificial
  Oligomer
aaaguguuucugucaucca

SEQ ID NO: 534 - RNA, 19 nt, artificial
  Oligomer
cacacgcaaauuuccuucc

SEQ ID NO: 535 - RNA, 19 nt, artificial
  Oligomer
gaagcucaaaacuuuuagc

SEQ ID NO: 536 - RNA, 19 nt, artificial
  Oligomer
aaaacuuuuagcgccaguc

SEQ ID NO: 537 - RNA, 19 nt, artificial
  Oligomer
uguaaaagauguugacccu

SEQ ID NO: 538 - RNA, 19 nt, artificial
  Oligomer
uaaaaggugguuucaaggc

SEQ ID NO: 539 - RNA, 19 nt, artificial
  Oligomer
uuaacccucacaaugcacu

SEQ ID NO: 540 - RNA, 19 nt, artificial
  Oligomer
aacccucacaaugcacucu

SEQ ID NO: 541 - RNA, 19 nt, artificial
  Oligomer
aaauucaacaugagggaca

SEQ ID NO: 542 - RNA, 19 nt, artificial
  Oligomer
gaaguaguuuccauagguc

SEQ ID NO: 543 - RNA, 19 nt, artificial
  Oligomer
uuacaucucccaaacaucc

SEQ ID NO: 544 - RNA, 19 nt, artificial
  Oligomer
uacaucucccaaacauccc

SEQ ID NO: 545 - RNA, 19 nt, artificial
  Oligomer
aggucugaaaauguuuccu

SEQ ID NO: 546 - RNA, 19 nt, artificial
  Oligomer
gugaaauauucuccaucca

SEQ ID NO: 547 - RNA, 19 nt, artificial
  Oligomer
uuucugucauccaaauacu

SEQ ID NO: 548 - RNA, 19 nt, artificial
  Oligomer
ucugucauccaaauacucc

SEQ ID NO: 549 - RNA, 19 nt, artificial
  Oligomer
acagaacguuguuuucagg

SEQ ID NO: 550 - RNA, 19 nt, artificial
  Oligomer
gaaacuaccaacccaccag

SEQ ID NO: 551 - RNA, 19 nt, artificial
  Oligomer
aacguuguuuucaggaagu

SEQ ID NO: 552 - RNA, 19 nt, artificial
  Oligomer
uuuuagcgccagucuugag

SEQ ID NO: 553 - RNA, 19 nt, artificial
  Oligomer
augccagcauuucacagau

SEQ ID NO: 554 - RNA, 19 nt, artificial
  Oligomer
uaugggccuugaaguuaga

SEQ ID NO: 555 - RNA, 19 nt, artificial
  Oligomer
aaaauucaacaugagggac

SEQ ID NO: 556 - RNA, 19 nt, artificial
  Oligomer
uaacugcaagaacauuucu

SEQ ID NO: 557 - RNA, 19 nt, artificial
  Oligomer
gacccaaaacccaaaaugg

SEQ ID NO: 558 - RNA, 19 nt, artificial
  Oligomer
gagaaugucagucugaguc

SEQ ID NO: 559 - RNA, 19 nt, artificial
  Oligomer
aaugucagucugagucagg

SEQ ID NO: 560 - RNA, 19 nt, artificial
  Oligomer
aaguguuucugucauccaa

SEQ ID NO: 561 - RNA, 19 nt, artificial
  Oligomer
ugucauccaaauacuccac

SEQ ID NO: 562 - RNA, 19 nt, artificial
  Oligomer
cucaaaacuuuuagcgcca

SEQ ID NO: 563 - RNA, 19 nt, artificial
  Oligomer
aaacuuuuagcgccagucu

SEQ ID NO: 564 - RNA, 19 nt, artificial
  Oligomer
uuuagguacuaaggucgac

SEQ ID NO: 565 - RNA, 19 nt, artificial
  Oligomer
aauaaaaggugguuucaag

SEQ ID NO: 566 - RNA, 19 nt, artificial
  Oligomer
aaacuaacccuuaacugca

SEQ ID NO: 567 - RNA, 19 nt, artificial
  Oligomer
uaguuuccauaggucugaa

SEQ ID NO: 568 - RNA, 19 nt, artificial
  Oligomer
aacaaaacaccagugcagg

SEQ ID NO: 569 - RNA, 19 nt, artificial
  Oligomer
uuccauaggucugaaaaug

SEQ ID NO: 570 - RNA, 19 nt, artificial
  Oligomer
gaaguggagaaugucaguc

SEQ ID NO: 571 - RNA, 19 nt, artificial
  Oligomer
agaaugucagucugaguca

SEQ ID NO: 572 - RNA, 19 nt, artificial
  Oligomer
aaauauucuccauccagug

SEQ ID NO: 573 - RNA, 19 nt, artificial
  Oligomer
auccagugguuucuucuuu

SEQ ID NO: 574 - RNA, 19 nt, artificial
  Oligomer
gagucuuccagugugauga

SEQ ID NO: 575 - RNA, 19 nt, artificial
  Oligomer
cugucauccaaauacucca

SEQ ID NO: 576 - RNA, 19 nt, artificial
  Oligomer
auccaaauacuccacacgc

SEQ ID NO: 577 - RNA, 19 nt, artificial
  Oligomer
ucaaaacuuuuagcgccag

SEQ ID NO: 578 - RNA, 19 nt, artificial
  Oligomer
gauauaaaaagggagaagg

SEQ ID NO: 579 - RNA, 19 nt, artificial
  Oligomer
aucaaaucauccauugcuu

SEQ ID NO: 580 - RNA, 19 nt, artificial
  Oligomer
caagacuugacaacucccu

SEQ ID NO: 581 - RNA, 19 nt, artificial
  Oligomer
auaaaaggugguuucaagg

SEQ ID NO: 582 - RNA, 19 nt, artificial
  Oligomer
auucaacaugagggacagc

SEQ ID NO: 583 - RNA, 19 nt, artificial
  Oligomer
cuuaacugcaagaacauuu

SEQ ID NO: 584 - RNA, 19 nt, artificial
  Oligomer
aacugcaagaacauuucuu

SEQ ID NO: 585 - RNA, 19 nt, artificial
  Oligomer
uuucuuacaucucccaaac

SEQ ID NO: 586 - RNA, 19 nt, artificial
  Oligomer
caacaaaacaccagugcag

SEQ ID NO: 587 - RNA, 19 nt, artificial
  Oligomer
aguggagaaugucagucug

SEQ ID NO: 588 - RNA, 19 nt, artificial
  Oligomer
gucugaaaauguuuccuga

SEQ ID NO: 589 - RNA, 19 nt, artificial
  Oligomer
uuccaaggccucauucagc

SEQ ID NO: 590 - RNA, 19 nt, artificial
  Oligomer
uccagugguuucuucuuug

SEQ ID NO: 591 - RNA, 19 nt, artificial
  Oligomer
cagugguuucuucuuuggc

SEQ ID NO: 592 - RNA, 19 nt, artificial
  Oligomer
agugguuucuucuuuggcu

SEQ ID NO: 593 - RNA, 19 nt, artificial
  Oligomer
auggugguacagucagagc

SEQ ID NO: 594 - RNA, 19 nt, artificial
  Oligomer
uucugucauccaaauacuc

SEQ ID NO: 595 - RNA, 19 nt, artificial
  Oligomer
ucauccaaauacuccacac

SEQ ID NO: 596 - RNA, 19 nt, artificial
  Oligomer
acacgcaaauuuccuucca

SEQ ID NO: 597 - RNA, 19 nt, artificial
  Oligomer
gauaagaugcugaggaggg

SEQ ID NO: 598 - RNA, 19 nt, artificial
  Oligomer
aaccuccgucaugugcugu

SEQ ID NO: 599 - RNA, 19 nt, artificial
  Oligomer
uuuuagguacuaaggucga

SEQ ID NO: 600 - RNA, 19 nt, artificial
  Oligomer
cagcaagacuugacaacuc

SEQ ID NO: 601 - RNA, 19 nt, artificial
  Oligomer
acccucacaaugcacucug

SEQ ID NO: 602 - RNA, 19 nt, artificial
  Oligomer
uuucacagauaugggccuu

SEQ ID NO: 603 - RNA, 19 nt, artificial
  Oligomer
aacuaacccuuaacugcaa

SEQ ID NO: 604 - RNA, 19 nt, artificial
  Oligomer
uaacccuuaacugcaagaa

SEQ ID NO: 605 - RNA, 19 nt, artificial
  Oligomer
acaucucccaaacaucccu

SEQ ID NO: 606 - RNA, 19 nt, artificial
  Oligomer
caucucccaaacaucccuc

SEQ ID NO: 607 - RNA, 19 nt, artificial
  Oligomer
ggucugaaaauguuuccug

SEQ ID NO: 608 - RNA, 19 nt, artificial
  Oligomer
aacaugaguuuuuuauggc

SEQ ID NO: 609 - RNA, 19 nt, artificial
  Oligomer
cauccaaauacuccacacg

SEQ ID NO: 610 - RNA, 19 nt, artificial
  Oligomer
gacagcaucaaaucaucca

SEQ ID NO: 611 - RNA, 19 nt, artificial
  Oligomer
uggcagcaaaguuuuauug

SEQ ID NO: 612 - RNA, 19 nt, artificial
  Oligomer
agcaucaaaucauccauug

SEQ ID NO: 613 - RNA, 19 nt, artificial
  Oligomer
aagacuugacaacucccuc

SEQ ID NO: 614 - RNA, 19 nt, artificial
  Oligomer
aacucccucuaccuaacca

SEQ ID NO: 615 - RNA, 19 nt, artificial
  Oligomer
uucaaggccagauguacau

SEQ ID NO: 616 - RNA, 19 nt, artificial
  Oligomer
uucaaagacccaaaaccca

SEQ ID NO: 617 - RNA, 19 nt, artificial
  Oligomer
augaguuuuuuauggcggg

SEQ ID NO: 618 - RNA, 19 nt, artificial
  Oligomer
auucagcucucggaacauc

SEQ ID NO: 619 - RNA, 19 nt, artificial
  Oligomer
uucagcucucggaacaucu

SEQ ID NO: 620 - RNA, 19 nt, artificial
  Oligomer
caggaacuguuacacaugu

SEQ ID NO: 621 - RNA, 19 nt, artificial
  Oligomer
uguaguuguaguggauggu

SEQ ID NO: 622 - RNA, 19 nt, artificial
  Oligomer
cuagacuuuugagaagcuc

SEQ ID NO: 623 - RNA, 19 nt, artificial
  Oligomer
caccaccacacuaugucga

SEQ ID NO: 624 - RNA, 19 nt, artificial
  Oligomer
ccacacgcaaauuuccuuc

SEQ ID NO: 625 - RNA, 19 nt, artificial
  Oligomer
aaggccagauguacauuau

SEQ ID NO: 626 - RNA, 19 nt, artificial
  Oligomer
guucaaagacccaaaaccc

SEQ ID NO: 627 - RNA, 19 nt, artificial
  Oligomer
cugacccuuuuuggacuuc

SEQ ID NO: 628 - RNA, 19 nt, artificial
  Oligomer
ucuagacuuuugagaagcu

SEQ ID NO: 629 - RNA, 19 nt, artificial
  Oligomer
acuccacacgcaaauuucc

SEQ ID NO: 630 - RNA, 19 nt, artificial
  Oligomer
acucccucuaccuaaccag

SEQ ID NO: 631 - RNA, 19 nt, artificial
  Oligomer
uuuuggacuucagguggcu

SEQ ID NO: 632 - RNA, 19 nt, artificial
  Oligomer
augucgaaaaguguuucug

SEQ ID NO: 633 - RNA, 19 nt, artificial
  Oligomer
uccaaauacuccacacgca

SEQ ID NO: 634 - RNA, 19 nt, artificial
  Oligomer
cuugacaacucccucuacc

SEQ ID NO: 635 - RNA, 19 nt, artificial
  Oligomer
uuaguacggugaagugggc

SEQ ID NO: 636 - RNA, 19 nt, artificial
  Oligomer
ucaaagcuguuccguccca

SEQ ID NO: 637 - RNA, 19 nt, artificial
  Oligomer
gucccagaaugcaagaagc

SEQ ID NO: 638 - RNA, 19 nt, artificial
  Oligomer
uaggugcaaaugccagcau

SEQ ID NO: 639 - RNA, 19 nt, artificial
  Oligomer
uuuucaggaaguaguuucc

SEQ ID NO: 640 - RNA, 19 nt, artificial
  Oligomer
gaagggugaaauauucucc

SEQ ID NO: 641 - RNA, 19 nt, artificial
  Oligomer
uaugucgaaaaguguuucu

SEQ ID NO: 642 - RNA, 19 nt, artificial
  Oligomer
caguuggcaaaacaucuug

SEQ ID NO: 643 - RNA, 19 nt, artificial
  Oligomer
aacaucuuguugagggcag

SEQ ID NO: 644 - RNA, 19 nt, artificial
  Oligomer
aagcucaaaacuuuuagcg

SEQ ID NO: 645 - RNA, 19 nt, artificial
  Oligomer
cuaccuagaauguggcuga

SEQ ID NO: 646 - RNA, 19 nt, artificial
  Oligomer
aagcaaauggaaguccugg

SEQ ID NO: 647 - RNA, 19 nt, artificial
  Oligomer
gaacaugaguuuuuuaugg

SEQ ID NO: 648 - RNA, 19 nt, artificial
  Oligomer
agugugaugauggugagga

SEQ ID NO: 649 - RNA, 19 nt, artificial
  Oligomer
ugugacugcuuguagaugg

SEQ ID NO: 650 - RNA, 19 nt, artificial
  Oligomer
uacuaaggucgaccaagag

SEQ ID NO: 651 - RNA, 19 nt, artificial
  Oligomer
uaccuaccuagaauguggc

SEQ ID NO: 652 - RNA, 19 nt, artificial
  Oligomer
aucccucacaguaaaaacc

SEQ ID NO: 653 - RNA, 19 nt, artificial
  Oligomer
agcaaauggaaguccuggg

SEQ ID NO: 654 - RNA, 19 nt, artificial
  Oligomer
acaugaguuuuuuauggcg

SEQ ID NO: 655 - RNA, 19 nt, artificial
  Oligomer
caugaguuuuuuauggcgg

SEQ ID NO: 656 - RNA, 19 nt, artificial
  Oligomer
gucgaaaaguguuucuguc

SEQ ID NO: 657 - RNA, 19 nt, artificial
  Oligomer
aagagaugaaauccuccag

SEQ ID NO: 658 - RNA, 19 nt, artificial
  Oligomer
aagagguugucagacaggg

SEQ ID NO: 659 - RNA, 19 nt, artificial
  Oligomer
aacuguagaaacuaccaac

SEQ ID NO: 660 - RNA, 19 nt, artificial
  Oligomer
acuguagaaacuaccaacc

SEQ ID NO: 661 - RNA, 19 nt, artificial
  Oligomer
cuguagaaacuaccaaccc

SEQ ID NO: 662 - RNA, 19 nt, artificial
  Oligomer
cuaccuaccuagaaugugg

SEQ ID NO: 663 - RNA, 19 nt, artificial
  Oligomer
cuaagcugguauguccuac

SEQ ID NO: 664 - RNA, 19 nt, artificial
  Oligomer
aaaacccaaaauggcaggg

SEQ ID NO: 665 - RNA, 19 nt, artificial
  Oligomer
ugaguuuuuuauggcggga

SEQ ID NO: 666 - RNA, 19 nt, artificial
  Oligomer
gaguuuuuuauggcgggag

SEQ ID NO: 667 - RNA, 19 nt, artificial
  Oligomer
auccuugaguuccaaggcc

SEQ ID NO: 668 - RNA, 19 nt, artificial
  Oligomer
aauguuuccugacucagag

SEQ ID NO: 669 - RNA, 19 nt, artificial
  Oligomer
aagggugaaauauucucca

SEQ ID NO: 670 - RNA, 19 nt, artificial
  Oligomer
acaucuuguugagggcagg

SEQ ID NO: 671 - RNA, 19 nt, artificial
  Oligomer
cuucagugaaccauuguuc

SEQ ID NO: 672 - RNA, 19 nt, artificial
  Oligomer
ugagguaggugcaaaugcc

SEQ ID NO: 673 - RNA, 19 nt, artificial
  Oligomer
guaggugcaaaugccagca

SEQ ID NO: 674 - RNA, 19 nt, artificial
  Oligomer
caaaacccaaaauggcagg

SEQ ID NO: 675 - RNA, 19 nt, artificial
  Oligomer
uuuauggcgggagguagac

SEQ ID NO: 676 - RNA, 19 nt, artificial
  Oligomer
cuugcggagauucucuucc

SEQ ID NO: 677 - RNA, 19 nt, artificial
  Oligomer
cuguuacacauguaguugu

SEQ ID NO: 678 - RNA, 19 nt, artificial
  Oligomer
gugacugcuuguagauggc

SEQ ID NO: 679 - RNA, 19 nt, artificial
  Oligomer
auauaaaaagggagaagga

SEQ ID NO: 680 - RNA, 19 nt, artificial
  Oligomer
auaaaaagggagaaggagg

SEQ ID NO: 681 - RNA, 19 nt, artificial
  Oligomer
uugucagacaggguuuggc

SEQ ID NO: 682 - RNA, 19 nt, artificial
  Oligomer
aaagcaaauggaaguccug

SEQ ID NO: 683 - RNA, 19 nt, artificial
  Oligomer
ugacccuuuuuggacuuca

SEQ ID NO: 684 - RNA, 19 nt, artificial
  Oligomer
gaaaauguuuccugacuca

SEQ ID NO: 685 - RNA, 19 nt, artificial
  Oligomer
aaggccucauucagcucuc

SEQ ID NO: 686 - RNA, 19 nt, artificial
  Oligomer
uuucuugcggagauucucu

SEQ ID NO: 687 - RNA, 19 nt, artificial
  Oligomer
uuccagugugaugauggug

SEQ ID NO: 688 - RNA, 19 nt, artificial
  Oligomer
accaucgcuaucugagcag

SEQ ID NO: 689 - RNA, 19 nt, artificial
  Oligomer
uauaaaaagggagaaggag

SEQ ID NO: 690 - RNA, 19 nt, artificial
  Oligomer
ucuugguggauccagauca

SEQ ID NO: 691 - RNA, 19 nt, artificial
  Oligomer
guuaguacggugaaguggg

SEQ ID NO: 692 - RNA, 19 nt, artificial
  Oligomer
augucagucugagucaggc

SEQ ID NO: 693 - RNA, 19 nt, artificial
  Oligomer
aaaauguuuccugacucag

SEQ ID NO: 694 - RNA, 19 nt, artificial
  Oligomer
uugcggagauucucuuccu

SEQ ID NO: 695 - RNA, 19 nt, artificial
  Oligomer
caugcaggaacuguuacac

SEQ ID NO: 696 - RNA, 19 nt, artificial
  Oligomer
aacuguuacacauguaguu

SEQ ID NO: 697 - RNA, 19 nt, artificial
  Oligomer
acuguuacacauguaguug

SEQ ID NO: 698 - RNA, 19 nt, artificial
  Oligomer
aguuggcaaaacaucuugu

SEQ ID NO: 699 - RNA, 19 nt, artificial
  Oligomer
gaaccauuguucaauaucg

SEQ ID NO: 700 - RNA, 19 nt, artificial
  Oligomer
gagauuuccuuuuagguac

SEQ ID NO: 701 - RNA, 19 nt, artificial
  Oligomer
aucauccauugcuugggac

SEQ ID NO: 702 - RNA, 19 nt, artificial
  Oligomer
cccauguaauaaaaggugg

SEQ ID NO: 703 - RNA, 19 nt, artificial
  Oligomer
aaaaggugguuucaaggcc

SEQ ID NO: 704 - RNA, 19 nt, artificial
  Oligomer
aaugccagcauuucacaga

SEQ ID NO: 705 - RNA, 19 nt, artificial
  Oligomer
uucaggaaguaguuuccau

SEQ ID NO: 706 - RNA, 19 nt, artificial
  Oligomer
uucccugguuaguacggug

SEQ ID NO: 707 - RNA, 19 nt, artificial
  Oligomer
aucuaagcugguauguccu

SEQ ID NO: 708 - RNA, 19 nt, artificial
  Oligomer
aaaacaccagugcaggcca

SEQ ID NO: 709 - RNA, 19 nt, artificial
  Oligomer
acgcacaccuauugcaagc

SEQ ID NO: 710 - RNA, 19 nt, artificial
  Oligomer
aguuuuuuauggcgggagg

SEQ ID NO: 711 - RNA, 19 nt, artificial
  Oligomer
uuuuuauggcgggagguag

SEQ ID NO: 712 - RNA, 19 nt, artificial
  Oligomer
ugaaaauguuuccugacuc

SEQ ID NO: 713 - RNA, 19 nt, artificial
  Oligomer
caaggccucauucagcucu

SEQ ID NO: 714 - RNA, 19 nt, artificial
  Oligomer
ggugaaauauucuccaucc

SEQ ID NO: 715 - RNA, 19 nt, artificial
  Oligomer
aauauucuccauccagugg

SEQ ID NO: 716 - RNA, 19 nt, artificial
  Oligomer
uucuugcggagauucucuu

SEQ ID NO: 717 - RNA, 19 nt, artificial
  Oligomer
aaauuuccuuccacucgga

SEQ ID NO: 718 - RNA, 19 nt, artificial
  Oligomer
uaucugagcagcgcucaug

SEQ ID NO: 719 - RNA, 19 nt, artificial
  Oligomer
augugcugugacugcuugu

SEQ ID NO: 720 - RNA, 19 nt, artificial
  Oligomer
agaagcucaaaacuuuuag

SEQ ID NO: 721 - RNA, 19 nt, artificial
  Oligomer
uuggcaaaacaucuuguug

SEQ ID NO: 722 - RNA, 19 nt, artificial
  Oligomer
uggcaaaacaucuuguuga

SEQ ID NO: 723 - RNA, 19 nt, artificial
  Oligomer
ugcaagucacagacuuggc

SEQ ID NO: 724 - RNA, 19 nt, artificial
  Oligomer
aagaagcccagacggaaac

SEQ ID NO: 725 - RNA, 19 nt, artificial
  Oligomer
augaaauccuccagggugu

SEQ ID NO: 726 - RNA, 19 nt, artificial
  Oligomer
aaaugccagcauuucacag

SEQ ID NO: 727 - RNA, 19 nt, artificial
  Oligomer
caaagcaaauggaaguccu

SEQ ID NO: 728 - RNA, 19 nt, artificial
  Oligomer
aaguccugggugcuucuga

SEQ ID NO: 729 - RNA, 19 nt, artificial
  Oligomer
cugaagggugaaauauucu

SEQ ID NO: 730 - RNA, 19 nt, artificial
  Oligomer
uauucuccauccagugguu

SEQ ID NO: 731 - RNA, 19 nt, artificial
  Oligomer
cccaguagauuaccacugg

SEQ ID NO: 732 - RNA, 19 nt, artificial
  Oligomer
caguagauuaccacuggag

SEQ ID NO: 733 - RNA, 19 nt, artificial
  Oligomer
uaccacuggagucuuccag

SEQ ID NO: 734 - RNA, 19 nt, artificial
  Oligomer
ucuuccagugugaugaugg

SEQ ID NO: 735 - RNA, 19 nt, artificial
  Oligomer
uuuccuuccacucggauaa

SEQ ID NO: 736 - RNA, 19 nt, artificial
  Oligomer
uuccacucggauaagaugc

SEQ ID NO: 737 - RNA, 19 nt, artificial
  Oligomer
caugugcugugacugcuug

SEQ ID NO: 738 - RNA, 19 nt, artificial
  Oligomer
guacgugcaagucacagac

SEQ ID NO: 739 - RNA, 19 nt, artificial
  Oligomer
gugcaagucacagacuugg

SEQ ID NO: 740 - RNA, 19 nt, artificial
  Oligomer
agcucaaaacuuuuagcgc

SEQ ID NO: 741 - RNA, 19 nt, artificial
  Oligomer
uuuucugggaagggacaga

SEQ ID NO: 742 - RNA, 19 nt, artificial
  Oligomer
aucuggaccugggucuuca

SEQ ID NO: 743 - RNA, 19 nt, artificial
  Oligomer
agaugugcuugcagaaugu

SEQ ID NO: 744 - RNA, 19 nt, artificial
  Oligomer
aaucauccauugcuuggga

SEQ ID NO: 745 - RNA, 19 nt, artificial
  Oligomer
uguagaaacuaccaaccca

SEQ ID NO: 746 - RNA, 19 nt, artificial
  Oligomer
guagaaacuaccaacccac

SEQ ID NO: 747 - RNA, 19 nt, artificial
  Oligomer
uagacugacccuuuuugga

SEQ ID NO: 748 - RNA, 19 nt, artificial
  Oligomer
ucucggaacaucucgaagc

SEQ ID NO: 749 - RNA, 19 nt, artificial
  Oligomer
ucuccauccagugguuucu

SEQ ID NO: 750 - RNA, 19 nt, artificial
  Oligomer
ucuugcggagauucucuuc

SEQ ID NO: 751 - RNA, 19 nt, artificial
  Oligomer
acgcaccucaaagcuguuc

SEQ ID NO: 752 - RNA, 19 nt, artificial
  Oligomer
ucccaguagauuaccacug

SEQ ID NO: 753 - RNA, 19 nt, artificial
  Oligomer
gauuaccacuggagucuuc

SEQ ID NO: 754 - RNA, 19 nt, artificial
  Oligomer
cacacuaugucgaaaagug

SEQ ID NO: 755 - RNA, 19 nt, artificial
  Oligomer
gacugcuuguagauggcca

SEQ ID NO: 756 - RNA, 19 nt, artificial
  Oligomer
gcucaaaacuuuuagcgcc

SEQ ID NO: 757 - RNA, 19 nt, artificial
  Oligomer
uucaucuggaccugggucu

SEQ ID NO: 758 - RNA, 19 nt, artificial
  Oligomer
aacaagucuugguggaucc

SEQ ID NO: 759 - RNA, 19 nt, artificial
  Oligomer
acaagagaugaaauccucc

SEQ ID NO: 760 - RNA, 19 nt, artificial
  Oligomer
uuucaggaaguaguuucca

SEQ ID NO: 761 - RNA, 19 nt, artificial
  Oligomer
aggaaguaguuuccauagg

SEQ ID NO: 762 - RNA, 19 nt, artificial
  Oligomer
aggccaacuuguucagugg

SEQ ID NO: 763 - RNA, 19 nt, artificial
  Oligomer
uauugcaagcaaggguuca

SEQ ID NO: 764 - RNA, 19 nt, artificial
  Oligomer
aagcaaggguucaaagacc

SEQ ID NO: 765 - RNA, 19 nt, artificial
  Oligomer
aacacgcaccucaaagcug

SEQ ID NO: 766 - RNA, 19 nt, artificial
  Oligomer
cuuccagugugaugauggu

SEQ ID NO: 767 - RNA, 19 nt, artificial
  Oligomer
uccagugugaugaugguga

SEQ ID NO: 768 - RNA, 19 nt, artificial
  Oligomer
uacacauguaguuguagug

SEQ ID NO: 769 - RNA, 19 nt, artificial
  Oligomer
uagggcaccaccacacuau

SEQ ID NO: 770 - RNA, 19 nt, artificial
  Oligomer
aagucacagacuuggcugu

SEQ ID NO: 771 - RNA, 19 nt, artificial
  Oligomer
uuucugggaagggacagaa

SEQ ID NO: 772 - RNA, 19 nt, artificial
  Oligomer
aagucuugguggauccaga

SEQ ID NO: 773 - RNA, 19 nt, artificial
  Oligomer
gagaugaaauccuccaggg

SEQ ID NO: 774 - RNA, 19 nt, artificial
  Oligomer
uuuccuuuuagguacuaag

SEQ ID NO: 775 - RNA, 19 nt, artificial
  Oligomer
uuagguacuaaggucgacc

SEQ ID NO: 776 - RNA, 19 nt, artificial
  Oligomer
guugucagacaggguuugg

SEQ ID NO: 777 - RNA, 19 nt, artificial
  Oligomer
gacagaacguuguuuucag

SEQ ID NO: 778 - RNA, 19 nt, artificial
  Oligomer
agcugguauguccuacucc

SEQ ID NO: 779 - RNA, 19 nt, artificial
  Oligomer
cugacgcacaccuauugca

SEQ ID NO: 780 - RNA, 19 nt, artificial
  Oligomer
uuagcgccagucuugagca

SEQ ID NO: 781 - RNA, 19 nt, artificial
  Oligomer
acccaaaacccaaaauggc

SEQ ID NO: 782 - RNA, 19 nt, artificial
  Oligomer
uguuuccugacucagaggg

SEQ ID NO: 783 - RNA, 19 nt, artificial
  Oligomer
ccagugguuucuucuuugg

SEQ ID NO: 784 - RNA, 19 nt, artificial
  Oligomer
cugcccugguagguuuucu

SEQ ID NO: 785 - RNA, 19 nt, artificial
  Oligomer
uucagugaaccauuguuca

SEQ ID NO: 786 - RNA, 19 nt, artificial
  Oligomer
auguugacccuuccagcuc

SEQ ID NO: 787 - RNA, 19 nt, artificial
  Oligomer
aaacaagucuugguggauc

SEQ ID NO: 788 - RNA, 19 nt, artificial
  Oligomer
cuaaggucgaccaagaggu

SEQ ID NO: 789 - RNA, 19 nt, artificial
  Oligomer
acaaugcacucugugaggu

SEQ ID NO: 790 - RNA, 19 nt, artificial
  Oligomer
aaugcacucugugagguag

SEQ ID NO: 791 - RNA, 19 nt, artificial
  Oligomer
cagcuucccugguuaguac

SEQ ID NO: 792 - RNA, 19 nt, artificial
  Oligomer
agcaaggguucaaagaccc

SEQ ID NO: 793 - RNA, 19 nt, artificial
  Oligomer
cuucugucuugaacaugag

SEQ ID NO: 794 - RNA, 19 nt, artificial
  Oligomer
uccaaggccucauucagcu

SEQ ID NO: 795 - RNA, 19 nt, artificial
  Oligomer
uuacacauguaguuguagu

SEQ ID NO: 796 - RNA, 19 nt, artificial
  Oligomer
uagguacuaaggucgacca

SEQ ID NO: 797 - RNA, 19 nt, artificial
  Oligomer
aaaggugguuucaaggcca

SEQ ID NO: 798 - RNA, 19 nt, artificial
  Oligomer
aaggugguuucaaggccag

SEQ ID NO: 799 - RNA, 19 nt, artificial
  Oligomer
acaaaacaccagugcaggc

SEQ ID NO: 800 - RNA, 19 nt, artificial
  Oligomer
gugcaggccaacuuguuca

SEQ ID NO: 801 - RNA, 19 nt, artificial
  Oligomer
accuauugcaagcaagggu

SEQ ID NO: 802 - RNA, 19 nt, artificial
  Oligomer
ugguuucuucuuuggcugg

SEQ ID NO: 803 - RNA, 19 nt, artificial
  Oligomer
gguuucuucuuuggcuggg

SEQ ID NO: 804 - RNA, 19 nt, artificial
  Oligomer
aaacacgcaccucaaagcu

SEQ ID NO: 805 - RNA, 19 nt, artificial
  Oligomer
cuggagucuuccaguguga

SEQ ID NO: 806 - RNA, 19 nt, artificial
  Oligomer
cucuagacuuuugagaagc

SEQ ID NO: 807 - RNA, 19 nt, artificial
  Oligomer
gauggugguacagucagag

SEQ ID NO: 808 - RNA, 19 nt, artificial
  Oligomer
uccacucggauaagaugcu

SEQ ID NO: 809 - RNA, 19 nt, artificial
  Oligomer
cacucggauaagaugcuga

SEQ ID NO: 810 - RNA, 19 nt, artificial
  Oligomer
uugagaagcucaaaacuuu

SEQ ID NO: 811 - RNA, 19 nt, artificial
  Oligomer
gucaugugcugugacugcu

SEQ ID NO: 812 - RNA, 19 nt, artificial
  Oligomer
ugacugcuuguagauggcc

SEQ ID NO: 813 - RNA, 19 nt, artificial
  Oligomer
uguggaaucaacccacagc

SEQ ID NO: 814 - RNA, 19 nt, artificial
  Oligomer
guggaaucaacccacagcu

SEQ ID NO: 815 - RNA, 19 nt, artificial
  Oligomer
uagguuuucugggaaggga

SEQ ID NO: 816 - RNA, 19 nt, artificial
  Oligomer
augcacucugugagguagg

SEQ ID NO: 817 - RNA, 19 nt, artificial
  Oligomer
cuucccugguuaguacggu

SEQ ID NO: 818 - RNA, 19 nt, artificial
  Oligomer
ucccugguuaguacgguga

SEQ ID NO: 819 - RNA, 19 nt, artificial
  Oligomer
ugcaggccaacuuguucag

SEQ ID NO: 820 - RNA, 19 nt, artificial
  Oligomer
cauccuugaguuccaaggc

SEQ ID NO: 821 - RNA, 19 nt, artificial
  Oligomer
gugguuucuucuuuggcug

SEQ ID NO: 822 - RNA, 19 nt, artificial
  Oligomer
acacgcaccucaaagcugu

SEQ ID NO: 823 - RNA, 19 nt, artificial
  Oligomer
cacauguaguuguagugga

SEQ ID NO: 824 - RNA, 19 nt, artificial
  Oligomer
uagacuuuugagaagcuca

SEQ ID NO: 825 - RNA, 19 nt, artificial
  Oligomer
acucggauaagaugcugag

SEQ ID NO: 826 - RNA, 19 nt, artificial
  Oligomer
gaaaaugcagaugugcuug

SEQ ID NO: 827 - RNA, 19 nt, artificial
  Oligomer
aaaugcagaugugcuugca

SEQ ID NO: 828 - RNA, 19 nt, artificial
  Oligomer
uuccuuuuagguacuaagg

SEQ ID NO: 829 - RNA, 19 nt, artificial
  Oligomer
acugcaagaacauuucuua

SEQ ID NO: 830 - RNA, 19 nt, artificial
  Oligomer
caccuauugcaagcaaggg

SEQ ID NO: 831 - RNA, 19 nt, artificial
  Oligomer
cuuuugagaagcucaaaac

SEQ ID NO: 832 - RNA, 19 nt, artificial
  Oligomer
ucggauaagaugcugagga

SEQ ID NO: 833 - RNA, 19 nt, artificial
  Oligomer
ucacaaugcacucugugag

SEQ ID NO: 834 - RNA, 19 nt, artificial
  Oligomer
ugcaagaacauuucuuaca

SEQ ID NO: 835 - RNA, 19 nt, artificial
  Oligomer
caacuuguucaguggagcc

SEQ ID NO: 836 - RNA, 19 nt, artificial
  Oligomer
agcucucggaacaucucga

SEQ ID NO: 837 - RNA, 19 nt, artificial
  Oligomer
aaggucgaccaagagguug

SEQ ID NO: 838 - RNA, 19 nt, artificial
  Oligomer
auugcaagcaaggguucaa

SEQ ID NO: 839 - RNA, 19 nt, artificial
  Oligomer
ucugggagcuucaucugga

SEQ ID NO: 840 - RNA, 19 nt, artificial
  Oligomer
aggucgaccaagagguugu

SEQ ID NO: 841 - RNA, 19 nt, artificial
  Oligomer
ucccagaaugcaagaagcc

SEQ ID NO: 842 - RNA, 19 nt, artificial
  Oligomer
augcagaugugcuugcaga

SEQ ID NO: 843 - RNA, 19 nt, artificial
  Oligomer
ucgaccaagagguugucag

SEQ ID NO: 844 - RNA, 19 nt, artificial
  Oligomer
aaugcagaugugcuugcag

SEQ ID NO: 845 - RNA, 19 nt, artificial
  Oligomer
cagaaugcaagaagcccag

SEQ ID NO: 846 - RNA, 19 nt, artificial
  Oligomer
ugcccugguagguuuucug

SEQ ID NO: 847 - RNA, 19 nt, artificial
  Oligomer
gaaugcaagaagcccagac

SEQ ID NO: 848 - RNA, 19 nt, artificial
  Oligomer
auguuuccugacucagagg

SEQ ID NO: 849 - RNA, 19 nt, artificial
  Oligomer
uccuugaguuccaaggccu

SEQ ID NO: 850 - RNA, 21 nt, artificial
  Oligomer
ccagcuuagauuuuaagguuu

SEQ ID NO: 851 - RNA, 21 nt, artificial
  Oligomer
cccauuuuuauaucgaucucu

SEQ ID NO: 852 - RNA, 21 nt, artificial
  Oligomer
ggacauaccagcuuagauuuu

SEQ ID NO: 853 - RNA, 21 nt, artificial
  Oligomer
ucccauuuuuauaucgaucuc

SEQ ID NO: 854 - RNA, 21 nt, artificial
  Oligomer
cucccuuuuuauaucccauuu

SEQ ID NO: 855 - RNA, 21 nt, artificial
  Oligomer
gcauugugaggguuaaugaaa

SEQ ID NO: 856 - RNA, 21 nt, artificial
  Oligomer
ccauuuuggguuuugggucuu

SEQ ID NO: 857 - RNA, 21 nt, artificial
  Oligomer
cccugucaucuucugucccuu

SEQ ID NO: 858 - RNA, 21 nt, artificial
  Oligomer
ggauuucaucucuuguauaug

SEQ ID NO: 859 - RNA, 21 nt, artificial
  Oligomer
ccucauguugaauuuucucua

SEQ ID NO: 860 - RNA, 21 nt, artificial
  Oligomer
caguuaaggguuaguuuacaa

SEQ ID NO: 861 - RNA, 21 nt, artificial
  Oligomer
gacauaccagcuuagauuuua

SEQ ID NO: 862 - RNA, 21 nt, artificial
  Oligomer
cccuucccagaaaaccuacca

SEQ ID NO: 863 - RNA, 21 nt, artificial
  Oligomer
cuuguauaugaugaucuggau

SEQ ID NO: 864 - RNA, 21 nt, artificial
  Oligomer
cuacuuccugaaaacaacguu

SEQ ID NO: 865 - RNA, 21 nt, artificial
  Oligomer
ggcccauaucugugaaaugcu

SEQ ID NO: 866 - RNA, 21 nt, artificial
  Oligomer
cucuaacuucaaggcccauau

SEQ ID NO: 867 - RNA, 21 nt, artificial
  Oligomer
gcugucccucauguugaauuu

SEQ ID NO: 868 - RNA, 21 nt, artificial
  Oligomer
uaguuuacaaucagccacauu

SEQ ID NO: 869 - RNA, 21 nt, artificial
  Oligomer
ggaaacauuuucagaccuaug

SEQ ID NO: 870 - RNA, 21 nt, artificial
  Oligomer
ugcccucaacaagauguuuug

SEQ ID NO: 871 - RNA, 21 nt, artificial
  Oligomer
ggucaacaucuuuuacauucu

SEQ ID NO: 872 - RNA, 21 nt, artificial
  Oligomer
agggucaacaucuuuuacauu

SEQ ID NO: 873 - RNA, 21 nt, artificial
  Oligomer
gagugcauugugaggguuaau

SEQ ID NO: 874 - RNA, 21 nt, artificial
  Oligomer
guuuacaaucagccacauucu

SEQ ID NO: 875 - RNA, 21 nt, artificial
  Oligomer
ggguuaguuuacaaucagcca

SEQ ID NO: 876 - RNA, 21 nt, artificial
  Oligomer
ggaguauuuggaugacagaaa

SEQ ID NO: 877 - RNA, 21 nt, artificial
  Oligomer
gugaggguuaaugaaauaaug

SEQ ID NO: 878 - RNA, 21 nt, artificial
  Oligomer
gugcauugugaggguuaauga

SEQ ID NO: 879 - RNA, 21 nt, artificial
  Oligomer
uuaguuuacaaucagccacau

SEQ ID NO: 880 - RNA, 21 nt, artificial
  Oligomer
agaaauguucuugcaguuaag

SEQ ID NO: 881 - RNA, 21 nt, artificial
  Oligomer
acauuuucagaccuauggaaa

SEQ ID NO: 882 - RNA, 21 nt, artificial
  Oligomer
ucagacugacauucuccacuu

SEQ ID NO: 883 - RNA, 21 nt, artificial
  Oligomer
aggaaacauuuucagaccuau

SEQ ID NO: 884 - RNA, 21 nt, artificial
  Oligomer
cccggacgauauugaacaaug

SEQ ID NO: 885 - RNA, 21 nt, artificial
  Oligomer
ccaccaagacuuguuuuaugc

SEQ ID NO: 886 - RNA, 21 nt, artificial
  Oligomer
ucucuuguauaugaugaucug

SEQ ID NO: 887 - RNA, 21 nt, artificial
  Oligomer
ccuugaaaccaccuuuuauua

SEQ ID NO: 888 - RNA, 21 nt, artificial
  Oligomer
ugcauugugaggguuaaugaa

SEQ ID NO: 889 - RNA, 21 nt, artificial
  Oligomer
gucccucauguugaauuuucu

SEQ ID NO: 890 - RNA, 21 nt, artificial
  Oligomer
cugucccucauguugaauuuu

SEQ ID NO: 891 - RNA, 21 nt, artificial
  Oligomer
gcaguuaaggguuaguuuaca

SEQ ID NO: 892 - RNA, 21 nt, artificial
  Oligomer
ccugucaucuucugucccuuc

SEQ ID NO: 893 - RNA, 21 nt, artificial
  Oligomer
ggacgauauugaacaaugguu

SEQ ID NO: 894 - RNA, 21 nt, artificial
  Oligomer
cggacgauauugaacaauggu

SEQ ID NO: 895 - RNA, 21 nt, artificial
  Oligomer
ucucccuuuuuauaucccauu

SEQ ID NO: 896 - RNA, 21 nt, artificial
  Oligomer
caacaucuuuuacauucugca

SEQ ID NO: 897 - RNA, 21 nt, artificial
  Oligomer
gucaacaucuuuuacauucug

SEQ ID NO: 898 - RNA, 21 nt, artificial
  Oligomer
gccuugaaaccaccuuuuauu

SEQ ID NO: 899 - RNA, 21 nt, artificial
  Oligomer
gcccauaucugugaaaugcug

SEQ ID NO: 900 - RNA, 21 nt, artificial
  Oligomer
gaaacuacuuccugaaaacaa

SEQ ID NO: 901 - RNA, 21 nt, artificial
  Oligomer
uaaggguuaguuuacaaucag

SEQ ID NO: 902 - RNA, 21 nt, artificial
  Oligomer
ccugacucagacugacauucu

SEQ ID NO: 903 - RNA, 21 nt, artificial
  Oligomer
cgagauguuccgagagcugaa

SEQ ID NO: 904 - RNA, 21 nt, artificial
  Oligomer
gguaaucuacugggacggaac

SEQ ID NO: 905 - RNA, 21 nt, artificial
  Oligomer
ggaaggaaauuugcgugugga

SEQ ID NO: 906 - RNA, 21 nt, artificial
  Oligomer
ccggacgauauugaacaaugg

SEQ ID NO: 907 - RNA, 21 nt, artificial
  Oligomer
gggucaacaucuuuuacauuc

SEQ ID NO: 908 - RNA, 21 nt, artificial
  Oligomer
ggaagggucaacaucuuuuac

SEQ ID NO: 909 - RNA, 21 nt, artificial
  Oligomer
uggaagggucaacaucuuuua

SEQ ID NO: 910 - RNA, 21 nt, artificial
  Oligomer
caccaagacuuguuuuaugcu

SEQ ID NO: 911 - RNA, 21 nt, artificial
  Oligomer
gcugguggguugguaguuucu

SEQ ID NO: 912 - RNA, 21 nt, artificial
  Oligomer
cagagugcauugugaggguua

SEQ ID NO: 913 - RNA, 21 nt, artificial
  Oligomer
gaauuuucucuaacuucaagg

SEQ ID NO: 914 - RNA, 21 nt, artificial
  Oligomer
cccucauguugaauuuucucu

SEQ ID NO: 915 - RNA, 21 nt, artificial
  Oligomer
ucccucauguugaauuuucuc

SEQ ID NO: 916 - RNA, 21 nt, artificial
  Oligomer
ucagaccuauggaaacuacuu

SEQ ID NO: 917 - RNA, 21 nt, artificial
  Oligomer
gcguguggaguauuuggauga

SEQ ID NO: 918 - RNA, 21 nt, artificial
  Oligomer
ggaaauuugcguguggaguau

SEQ ID NO: 919 - RNA, 21 nt, artificial
  Oligomer
aagggucaacaucuuuuacau

SEQ ID NO: 920 - RNA, 21 nt, artificial
  Oligomer
gggaguugucaagucuugcug

SEQ ID NO: 921 - RNA, 21 nt, artificial
  Oligomer
agagugcauugugaggguuaa

SEQ ID NO: 922 - RNA, 21 nt, artificial
  Oligomer
acagagugcauugugaggguu

SEQ ID NO: 923 - RNA, 21 nt, artificial
  Oligomer
caaggcccauaucugugaaau

SEQ ID NO: 924 - RNA, 21 nt, artificial
  Oligomer
gagggauguuugggagaugua

SEQ ID NO: 925 - RNA, 21 nt, artificial
  Oligomer
cauuuuggguuuugggucuuu

SEQ ID NO: 926 - RNA, 21 nt, artificial
  Oligomer
ugacauucuccacuucuuguu

SEQ ID NO: 927 - RNA, 21 nt, artificial
  Oligomer
cacuggauggagaauauuuca

SEQ ID NO: 928 - RNA, 21 nt, artificial
  Oligomer
caccauccacuacaacuacau

SEQ ID NO: 929 - RNA, 21 nt, artificial
  Oligomer
gaguauuuggaugacagaaac

SEQ ID NO: 930 - RNA, 21 nt, artificial
  Oligomer
gaaauuugcguguggaguauu

SEQ ID NO: 931 - RNA, 21 nt, artificial
  Oligomer
agacuggcgcuaaaaguuuug

SEQ ID NO: 932 - RNA, 21 nt, artificial
  Oligomer
uucucccuuuuuauaucccau

SEQ ID NO: 933 - RNA, 21 nt, artificial
  Oligomer
ucaacaucuuuuacauucugc

SEQ ID NO: 934 - RNA, 21 nt, artificial
  Oligomer
ucaagacuggcgcuaaaaguu

SEQ ID NO: 935 - RNA, 21 nt, artificial
  Oligomer
ucaaggcccauaucugugaaa

SEQ ID NO: 936 - RNA, 21 nt, artificial
  Oligomer
gacugacauucuccacuucuu

SEQ ID NO: 937 - RNA, 21 nt, artificial
  Oligomer
cagacugacauucuccacuuc

SEQ ID NO: 938 - RNA, 21 nt, artificial
  Oligomer
gcgcacagaggaagagaaucu

SEQ ID NO: 939 - RNA, 21 nt, artificial
  Oligomer
ugguaaucuacugggacggaa

SEQ ID NO: 940 - RNA, 21 nt, artificial
  Oligomer
gugguaaucuacugggacgga

SEQ ID NO: 941 - RNA, 21 nt, artificial
  Oligomer
guggaguauuuggaugacaga

SEQ ID NO: 942 - RNA, 21 nt, artificial
  Oligomer
cgaguggaaggaaauuugcgu

SEQ ID NO: 943 - RNA, 21 nt, artificial
  Oligomer
acagcacaugacggagguugu

SEQ ID NO: 944 - RNA, 21 nt, artificial
  Oligomer
caagacuggcgcuaaaaguuu

SEQ ID NO: 945 - RNA, 21 nt, artificial
  Oligomer
caagcaauggaugauuugaug

SEQ ID NO: 946 - RNA, 21 nt, artificial
  Oligomer
uggcugguggguugguaguuu

SEQ ID NO: 947 - RNA, 21 nt, artificial
  Oligomer
aagcugucccucauguugaau

SEQ ID NO: 948 - RNA, 21 nt, artificial
  Oligomer
cuugcaguuaaggguuaguuu

SEQ ID NO: 949 - RNA, 21 nt, artificial
  Oligomer
uugggagauguaagaaauguu

SEQ ID NO: 950 - RNA, 21 nt, artificial
  Oligomer
uguuugggagauguaagaaau

SEQ ID NO: 951 - RNA, 21 nt, artificial
  Oligomer
ggauguuugggagauguaaga

SEQ ID NO: 952 - RNA, 21 nt, artificial
  Oligomer
ccugcacugguguuuuguugu

SEQ ID NO: 953 - RNA, 21 nt, artificial
  Oligomer
aaacauuuucagaccuaugga

SEQ ID NO: 954 - RNA, 21 nt, artificial
  Oligomer
gacauucuccacuucuuguuc

SEQ ID NO: 955 - RNA, 21 nt, artificial
  Oligomer
agauguuccgagagcugaaug

SEQ ID NO: 956 - RNA, 21 nt, artificial
  Oligomer
aguauuuggaugacagaaaca

SEQ ID NO: 957 - RNA, 21 nt, artificial
  Oligomer
gaaggaaauuugcguguggag

SEQ ID NO: 958 - RNA, 21 nt, artificial
  Oligomer
caauggaugauuugaugcugu

SEQ ID NO: 959 - RNA, 21 nt, artificial
  Oligomer
ggaguugucaagucuugcugg

SEQ ID NO: 960 - RNA, 21 nt, artificial
  Oligomer
guagagggaguugucaagucu

SEQ ID NO: 961 - RNA, 21 nt, artificial
  Oligomer
gcugguuagguagagggaguu

SEQ ID NO: 962 - RNA, 21 nt, artificial
  Oligomer
gaaauaauguacaucuggccu

SEQ ID NO: 963 - RNA, 21 nt, artificial
  Oligomer
ugaaauaauguacaucuggcc

SEQ ID NO: 964 - RNA, 21 nt, artificial
  Oligomer
gauguuugggagauguaagaa

SEQ ID NO: 965 - RNA, 21 nt, artificial
  Oligomer
gggauguuugggagauguaag

SEQ ID NO: 966 - RNA, 21 nt, artificial
  Oligomer
ugagggauguuugggagaugu

SEQ ID NO: 967 - RNA, 21 nt, artificial
  Oligomer
gugagggauguuugggagaug

SEQ ID NO: 968 - RNA, 21 nt, artificial
  Oligomer
acugacauucuccacuucuug

SEQ ID NO: 969 - RNA, 21 nt, artificial
  Oligomer
gagauguuccgagagcugaau

SEQ ID NO: 970 - RNA, 21 nt, artificial
  Oligomer
caaagaagaaaccacuggaug

SEQ ID NO: 971 - RNA, 21 nt, artificial
  Oligomer
uggaguauuuggaugacagaa

SEQ ID NO: 972 - RNA, 21 nt, artificial
  Oligomer
guguggaguauuuggaugaca

SEQ ID NO: 973 - RNA, 21 nt, artificial
  Oligomer
cguguggaguauuuggaugac

SEQ ID NO: 974 - RNA, 21 nt, artificial
  Oligomer
guggaaggaaauuugcgugug

SEQ ID NO: 975 - RNA, 21 nt, artificial
  Oligomer
cuggaagggucaacaucuuuu

SEQ ID NO: 976 - RNA, 21 nt, artificial
  Oligomer
ucuugcaguuaaggguuaguu

SEQ ID NO: 977 - RNA, 21 nt, artificial
  Oligomer
ugggagauguaagaaauguuc

SEQ ID NO: 978 - RNA, 21 nt, artificial
  Oligomer
agggauguuugggagauguaa

SEQ ID NO: 979 - RNA, 21 nt, artificial
  Oligomer
gcacugguguuuuguuguggg

SEQ ID NO: 980 - RNA, 21 nt, artificial
  Oligomer
ccaccauccacuacaacuaca

SEQ ID NO: 981 - RNA, 21 nt, artificial
  Oligomer
aggaaauuugcguguggagua

SEQ ID NO: 982 - RNA, 21 nt, artificial
  Oligomer
ccgccauaaaaaacucauguu

SEQ ID NO: 983 - RNA, 21 nt, artificial
  Oligomer
ugaaguccaaaaagggucagu

SEQ ID NO: 984 - RNA, 21 nt, artificial
  Oligomer
ucaaaagucuagagccaccgu

SEQ ID NO: 985 - RNA, 21 nt, artificial
  Oligomer
acagaaacacuuuucgacaua

SEQ ID NO: 986 - RNA, 21 nt, artificial
  Oligomer
gguuagguagagggaguuguc

SEQ ID NO: 987 - RNA, 21 nt, artificial
  Oligomer
aauguacaucuggccuugaaa

SEQ ID NO: 988 - RNA, 21 nt, artificial
  Oligomer
gaaguccaaaaagggucaguc

SEQ ID NO: 989 - RNA, 21 nt, artificial
  Oligomer
accaccauccacuacaacuac

SEQ ID NO: 990 - RNA, 21 nt, artificial
  Oligomer
gcuucuugcauucugggacag

SEQ ID NO: 991 - RNA, 21 nt, artificial
  Oligomer
gguugguaguuucuacaguug

SEQ ID NO: 992 - RNA, 21 nt, artificial
  Oligomer
ggguugguaguuucuacaguu

SEQ ID NO: 993 - RNA, 21 nt, artificial
  Oligomer
ggaguaggacauaccagcuua

SEQ ID NO: 994 - RNA, 21 nt, artificial
  Oligomer
agcacccaggacuuccauuug

SEQ ID NO: 995 - RNA, 21 nt, artificial
  Oligomer
cccugcccucaacaagauguu

SEQ ID NO: 996 - RNA, 21 nt, artificial
  Oligomer
cugguuagguagagggaguug

SEQ ID NO: 997 - RNA, 21 nt, artificial
  Oligomer
gcauuugcaccuaccucacag

SEQ ID NO: 998 - RNA, 21 nt, artificial
  Oligomer
gccauaaaaaacucauguuca

SEQ ID NO: 999 - RNA, 21 nt, artificial
  Oligomer
cgccauaaaaaacucauguuc

SEQ ID NO: 1000 - RNA, 21 nt, artificial
  Oligomer
agccaccugaaguccaaaaag

SEQ ID NO: 1001 - RNA, 21 nt, artificial
  Oligomer
cccauccucaccaucaucaca

SEQ ID NO: 1002 - RNA, 21 nt, artificial
  Oligomer
ccauccucaccaucaucacac

SEQ ID NO: 1003 - RNA, 21 nt, artificial
  Oligomer
gcgcuaaaaguuuugagcuuc

SEQ ID NO: 1004 - RNA, 21 nt, artificial
  Oligomer
acccugucugacaaccucuug

SEQ ID NO: 1005 - RNA, 21 nt, artificial
  Oligomer
ugacagaaacacuuuucgaca

SEQ ID NO: 1006 - RNA, 21 nt, artificial
  Oligomer
ggcgcuaaaaguuuugagcuu

SEQ ID NO: 1007 - RNA, 21 nt, artificial
  Oligomer
ggaggauuucaucucuuguau

SEQ ID NO: 1008 - RNA, 21 nt, artificial
  Oligomer
gggagauguaagaaauguucu

SEQ ID NO: 1009 - RNA, 21 nt, artificial
  Oligomer
ggagaauauuucacccuucag

SEQ ID NO: 1010 - RNA, 21 nt, artificial
  Oligomer
gaagagaaucuccgcaagaaa

SEQ ID NO: 1011 - RNA, 21 nt, artificial
  Oligomer
ucauggcgacuguccagcuuu

SEQ ID NO: 1012 - RNA, 21 nt, artificial
  Oligomer
cccuccuucucccuuuuuaua

SEQ ID NO: 1013 - RNA, 21 nt, artificial
  Oligomer
cccuggaggauuucaucucuu

SEQ ID NO: 1014 - RNA, 21 nt, artificial
  Oligomer
cuauggaaacuacuuccugaa

SEQ ID NO: 1015 - RNA, 21 nt, artificial
  Oligomer
guuuuuacugugagggauguu

SEQ ID NO: 1016 - RNA, 21 nt, artificial
  Oligomer
cucccgccauaaaaaacucau

SEQ ID NO: 1017 - RNA, 21 nt, artificial
  Oligomer
agaauauuucacccuucagau

SEQ ID NO: 1018 - RNA, 21 nt, artificial
  Oligomer
agaaaccacuggauggagaau

SEQ ID NO: 1019 - RNA, 21 nt, artificial
  Oligomer
agaggaagagaaucuccgcaa

SEQ ID NO: 1020 - RNA, 21 nt, artificial
  Oligomer
gacagaaacacuuuucgacau

SEQ ID NO: 1021 - RNA, 21 nt, artificial
  Oligomer
cuacaagcagucacagcacau

SEQ ID NO: 1022 - RNA, 21 nt, artificial
  Oligomer
ccugcccucaacaagauguuu

SEQ ID NO: 1023 - RNA, 21 nt, artificial
  Oligomer
ccuccuucucccuuuuuauau

SEQ ID NO: 1024 - RNA, 21 nt, artificial
  Oligomer
guauaugaugaucuggaucca

SEQ ID NO: 1025 - RNA, 21 nt, artificial
  Oligomer
agccacauucuagguagguag

SEQ ID NO: 1026 - RNA, 21 nt, artificial
  Oligomer
guaagaaauguucuugcaguu

SEQ ID NO: 1027 - RNA, 21 nt, artificial
  Oligomer
agguuuuuacugugagggaug

SEQ ID NO: 1028 - RNA, 21 nt, artificial
  Oligomer
accagcuuagauuuuaagguu

SEQ ID NO: 1029 - RNA, 21 nt, artificial
  Oligomer
aggacauaccagcuuagauuu

SEQ ID NO: 1030 - RNA, 21 nt, artificial
  Oligomer
guaggacauaccagcuuagau

SEQ ID NO: 1031 - RNA, 21 nt, artificial
  Oligomer
caggacuuccauuugcuuugu

SEQ ID NO: 1032 - RNA, 21 nt, artificial
  Oligomer
ccucccgccauaaaaaacuca

SEQ ID NO: 1033 - RNA, 21 nt, artificial
  Oligomer
ccaaaaagggucagucuaccu

SEQ ID NO: 1034 - RNA, 21 nt, artificial
  Oligomer
ccacuacaacuacauguguaa

SEQ ID NO: 1035 - RNA, 21 nt, artificial
  Oligomer
cagaaacacuuuucgacauag

SEQ ID NO: 1036 - RNA, 21 nt, artificial
  Oligomer
ucagccacauucuagguaggu

SEQ ID NO: 1037 - RNA, 21 nt, artificial
  Oligomer
ccaggacuuccauuugcuuug

SEQ ID NO: 1038 - RNA, 21 nt, artificial
  Oligomer
cccaggacuuccauuugcuuu

SEQ ID NO: 1039 - RNA, 21 nt, artificial
  Oligomer
gugcucaagacuggcgcuaaa

SEQ ID NO: 1040 - RNA, 21 nt, artificial
  Oligomer
gucuaccucccgccauaaaaa

SEQ ID NO: 1041 - RNA, 21 nt, artificial
  Oligomer
ccugaaguccaaaaaggguca

SEQ ID NO: 1042 - RNA, 21 nt, artificial
  Oligomer
ggaagagaaucuccgcaagaa

SEQ ID NO: 1043 - RNA, 21 nt, artificial
  Oligomer
caccaucaucacacuggaaga

SEQ ID NO: 1044 - RNA, 21 nt, artificial
  Oligomer
cucaccaucaucacacuggaa

SEQ ID NO: 1045 - RNA, 21 nt, artificial
  Oligomer
cgcuaaaaguuuugagcuucu

SEQ ID NO: 1046 - RNA, 21 nt, artificial
  Oligomer
gaggauuucaucucuuguaua

SEQ ID NO: 1047 - RNA, 21 nt, artificial
  Oligomer
gucccaagcaauggaugauuu

SEQ ID NO: 1048 - RNA, 21 nt, artificial
  Oligomer
ugcuggcauuugcaccuaccu

SEQ ID NO: 1049 - RNA, 21 nt, artificial
  Oligomer
ggaaacuacuuccugaaaaca

SEQ ID NO: 1050 - RNA, 21 nt, artificial
  Oligomer
cagccacauucuagguaggua

SEQ ID NO: 1051 - RNA, 21 nt, artificial
  Oligomer
ggacuuccauuugcuuugucc

SEQ ID NO: 1052 - RNA, 21 nt, artificial
  Oligomer
gcaauaggugugcgucagaag

SEQ ID NO: 1053 - RNA, 21 nt, artificial
  Oligomer
ggccugacucagacugacauu

SEQ ID NO: 1054 - RNA, 21 nt, artificial
  Oligomer
cccgccauaaaaaacucaugu

SEQ ID NO: 1055 - RNA, 21 nt, artificial
  Oligomer
ugagucaggaaacauuuucag

SEQ ID NO: 1056 - RNA, 21 nt, artificial
  Oligomer
gauggagaauauuucacccuu

SEQ ID NO: 1057 - RNA, 21 nt, artificial
  Oligomer
aaaccacuggauggagaauau

SEQ ID NO: 1058 - RNA, 21 nt, artificial
  Oligomer
ccagccaaagaagaaaccacu

SEQ ID NO: 1059 - RNA, 21 nt, artificial
  Oligomer
agaaacacuuuucgacauagu

SEQ ID NO: 1060 - RNA, 21 nt, artificial
  Oligomer
caacaagauguuuugccaacu

SEQ ID NO: 1061 - RNA, 21 nt, artificial
  Oligomer
cucaacaagauguuuugccaa

SEQ ID NO: 1062 - RNA, 21 nt, artificial
  Oligomer
guggguugguaguuucuacag

SEQ ID NO: 1063 - RNA, 21 nt, artificial
  Oligomer
acaaucagccacauucuaggu

SEQ ID NO: 1064 - RNA, 21 nt, artificial
  Oligomer
ggccugcacugguguuuuguu

SEQ ID NO: 1065 - RNA, 21 nt, artificial
  Oligomer
ugcucaagacuggcgcuaaaa

SEQ ID NO: 1066 - RNA, 21 nt, artificial
  Oligomer
caggaaacauuuucagaccua

SEQ ID NO: 1067 - RNA, 21 nt, artificial
  Oligomer
cagucuaccucccgccauaaa

SEQ ID NO: 1068 - RNA, 21 nt, artificial
  Oligomer
ccaccugaaguccaaaaaggg

SEQ ID NO: 1069 - RNA, 21 nt, artificial
  Oligomer
gagucaggaaacauuuucaga

SEQ ID NO: 1070 - RNA, 21 nt, artificial
  Oligomer
cugagucaggaaacauuuuca

SEQ ID NO: 1071 - RNA, 21 nt, artificial
  Oligomer
ggauggagaauauuucacccu

SEQ ID NO: 1072 - RNA, 21 nt, artificial
  Oligomer
cucugagucaggaaacauuuu

SEQ ID NO: 1073 - RNA, 21 nt, artificial
  Oligomer
ccaaagaagaaaccacuggau

SEQ ID NO: 1074 - RNA, 21 nt, artificial
  Oligomer
gaggaagagaaucuccgcaag

SEQ ID NO: 1075 - RNA, 21 nt, artificial
  Oligomer
ggaagacuccagugguaaucu

SEQ ID NO: 1076 - RNA, 21 nt, artificial
  Oligomer
ccaucaucacacuggaagacu

SEQ ID NO: 1077 - RNA, 21 nt, artificial
  Oligomer
ggaugacagaaacacuuuucg

SEQ ID NO: 1078 - RNA, 21 nt, artificial
  Oligomer
acaagauguuuugccaacugg

SEQ ID NO: 1079 - RNA, 21 nt, artificial
  Oligomer
ccucaacaagauguuuugcca

SEQ ID NO: 1080 - RNA, 21 nt, artificial
  Oligomer
cugcccucaacaagauguuuu

SEQ ID NO: 1081 - RNA, 21 nt, artificial
  Oligomer
gaacaaugguucacugaagac

SEQ ID NO: 1082 - RNA, 21 nt, artificial
  Oligomer
cuggaggauuucaucucuugu

SEQ ID NO: 1083 - RNA, 21 nt, artificial
  Oligomer
ccuggaggauuucaucucuug

SEQ ID NO: 1084 - RNA, 21 nt, artificial
  Oligomer
ccacacccuggaggauuucau

SEQ ID NO: 1085 - RNA, 21 nt, artificial
  Oligomer
cgucccaagcaauggaugauu

SEQ ID NO: 1086 - RNA, 21 nt, artificial
  Oligomer
cagccaaacccugucugacaa

SEQ ID NO: 1087 - RNA, 21 nt, artificial
  Oligomer
cccacuucaccguacuaacca

SEQ ID NO: 1088 - RNA, 21 nt, artificial
  Oligomer
aggacuuccauuugcuuuguc

SEQ ID NO: 1089 - RNA, 21 nt, artificial
  Oligomer
ucagucuaccucccgccauaa

SEQ ID NO: 1090 - RNA, 21 nt, artificial
  Oligomer
uggagaauauuucacccuuca

SEQ ID NO: 1091 - RNA, 21 nt, artificial
  Oligomer
aaccacuggauggagaauauu

SEQ ID NO: 1092 - RNA, 21 nt, artificial
  Oligomer
ccagugguaaucuacugggac

SEQ ID NO: 1093 - RNA, 21 nt, artificial
  Oligomer
gaaacacuuuucgacauagug

SEQ ID NO: 1094 - RNA, 21 nt, artificial
  Oligomer
uggaugacagaaacacuuuuc

SEQ ID NO: 1095 - RNA, 21 nt, artificial
  Oligomer
cuuauccgaguggaaggaaau

SEQ ID NO: 1096 - RNA, 21 nt, artificial
  Oligomer
gcccucaacaagauguuuugc

SEQ ID NO: 1097 - RNA, 21 nt, artificial
  Oligomer
cagccaagucugugacuugca

SEQ ID NO: 1098 - RNA, 21 nt, artificial
  Oligomer
uggaggauuucaucucuugua

SEQ ID NO: 1099 - RNA, 21 nt, artificial
  Oligomer
uggcauuugcaccuaccucac

SEQ ID NO: 1100 - RNA, 21 nt, artificial
  Oligomer
agggaagcugucccucauguu

SEQ ID NO: 1101 - RNA, 21 nt, artificial
  Oligomer
uggaaacuacuuccugaaaac

SEQ ID NO: 1102 - RNA, 21 nt, artificial
  Oligomer
accuauggaaacuacuuccug

SEQ ID NO: 1103 - RNA, 21 nt, artificial
  Oligomer
uggccugcacugguguuuugu

SEQ ID NO: 1104 - RNA, 21 nt, artificial
  Oligomer
agaagcacccaggacuuccau

SEQ ID NO: 1105 - RNA, 21 nt, artificial
  Oligomer
gaagacuccagugguaaucua

SEQ ID NO: 1106 - RNA, 21 nt, artificial
  Oligomer
cauguguaacaguuccugcau

SEQ ID NO: 1107 - RNA, 21 nt, artificial
  Oligomer
ggccaucuacaagcagucaca

SEQ ID NO: 1108 - RNA, 21 nt, artificial
  Oligomer
gaaaaccuaccagggcagcua

SEQ ID NO: 1109 - RNA, 21 nt, artificial
  Oligomer
cuucugucccuucccagaaaa

SEQ ID NO: 1110 - RNA, 21 nt, artificial
  Oligomer
ucaucuucugucccuucccag

SEQ ID NO: 1111 - RNA, 21 nt, artificial
  Oligomer
ccaaacccugucugacaaccu

SEQ ID NO: 1112 - RNA, 21 nt, artificial
  Oligomer
ccgucccaagcaauggaugau

SEQ ID NO: 1113 - RNA, 21 nt, artificial
  Oligomer
gguggguugguaguuucuaca

SEQ ID NO: 1114 - RNA, 21 nt, artificial
  Oligomer
ggcauuugcaccuaccucaca

SEQ ID NO: 1115 - RNA, 21 nt, artificial
  Oligomer
aucugugaaaugcuggcauuu

SEQ ID NO: 1116 - RNA, 21 nt, artificial
  Oligomer
cccauaucugugaaaugcugg

SEQ ID NO: 1117 - RNA, 21 nt, artificial
  Oligomer
acccaggacuuccauuugcuu

SEQ ID NO: 1118 - RNA, 21 nt, artificial
  Oligomer
gaaaccacuggauggagaaua

SEQ ID NO: 1119 - RNA, 21 nt, artificial
  Oligomer
aggaagagaaucuccgcaaga

SEQ ID NO: 1120 - RNA, 21 nt, artificial
  Oligomer
caacuacauguguaacaguuc

SEQ ID NO: 1121 - RNA, 21 nt, artificial
  Oligomer
acauagugugguggugcccua

SEQ ID NO: 1122 - RNA, 21 nt, artificial
  Oligomer
cugcucagauagcgauggucu

SEQ ID NO: 1123 - RNA, 21 nt, artificial
  Oligomer
ucacagcacaugacggagguu

SEQ ID NO: 1124 - RNA, 21 nt, artificial
  Oligomer
gcuaaaaguuuugagcuucuc

SEQ ID NO: 1125 - RNA, 21 nt, artificial
  Oligomer
gaagacccagguccagaugaa

SEQ ID NO: 1126 - RNA, 21 nt, artificial
  Oligomer
gcuggaagggucaacaucuuu

SEQ ID NO: 1127 - RNA, 21 nt, artificial
  Oligomer
ggauccaccaagacuuguuuu

SEQ ID NO: 1128 - RNA, 21 nt, artificial
  Oligomer
ccaagcaauggaugauuugau

SEQ ID NO: 1129 - RNA, 21 nt, artificial
  Oligomer
ggccuugaaaccaccuuuuau

SEQ ID NO: 1130 - RNA, 21 nt, artificial
  Oligomer
ccuaccucacagagugcauug

SEQ ID NO: 1131 - RNA, 21 nt, artificial
  Oligomer
ugugaaaugcuggcauuugca

SEQ ID NO: 1132 - RNA, 21 nt, artificial
  Oligomer
gccacauucuagguagguagg

SEQ ID NO: 1133 - RNA, 21 nt, artificial
  Oligomer
gaguaggacauaccagcuuag

SEQ ID NO: 1134 - RNA, 21 nt, artificial
  Oligomer
gggaguaggacauaccagcuu

SEQ ID NO: 1135 - RNA, 21 nt, artificial
  Oligomer
ucccgccauaaaaaacucaug

SEQ ID NO: 1136 - RNA, 21 nt, artificial
  Oligomer
gagcugaaugaggccuuggaa

SEQ ID NO: 1137 - RNA, 21 nt, artificial
  Oligomer
ccacuggauggagaauauuuc

SEQ ID NO: 1138 - RNA, 21 nt, artificial
  Oligomer
aagaaaccacuggauggagaa

SEQ ID NO: 1139 - RNA, 21 nt, artificial
  Oligomer
gccaaagaagaaaccacugga

SEQ ID NO: 1140 - RNA, 21 nt, artificial
  Oligomer
cgcacagaggaagagaaucuc

SEQ ID NO: 1141 - RNA, 21 nt, artificial
  Oligomer
cuacaacuacauguguaacag

SEQ ID NO: 1142 - RNA, 21 nt, artificial
  Oligomer
cuguaccaccauccacuacaa

SEQ ID NO: 1143 - RNA, 21 nt, artificial
  Oligomer
ugacuguaccaccauccacua

SEQ ID NO: 1144 - RNA, 21 nt, artificial
  Oligomer
cauagugugguggugcccuau

SEQ ID NO: 1145 - RNA, 21 nt, artificial
  Oligomer
cagcaucuuauccgaguggaa

SEQ ID NO: 1146 - RNA, 21 nt, artificial
  Oligomer
cuaaaaguuuugagcuucuca

SEQ ID NO: 1147 - RNA, 21 nt, artificial
  Oligomer
gucugugacuugcacguacuc

SEQ ID NO: 1148 - RNA, 21 nt, artificial
  Oligomer
caagucugugacuugcacgua

SEQ ID NO: 1149 - RNA, 21 nt, artificial
  Oligomer
cgucugggcuucuugcauucu

SEQ ID NO: 1150 - RNA, 21 nt, artificial
  Oligomer
ccagaugaagcucccagaaug

SEQ ID NO: 1151 - RNA, 21 nt, artificial
  Oligomer
ugaacaaugguucacugaaga

SEQ ID NO: 1152 - RNA, 21 nt, artificial
  Oligomer
caagcacaucugcauuuucac

SEQ ID NO: 1153 - RNA, 21 nt, artificial
  Oligomer
uggagcuggaagggucaacau

SEQ ID NO: 1154 - RNA, 21 nt, artificial
  Oligomer
gacaaccucuuggucgaccuu

SEQ ID NO: 1155 - RNA, 21 nt, artificial
  Oligomer
uggccuugaaaccaccuuuua

SEQ ID NO: 1156 - RNA, 21 nt, artificial
  Oligomer
caccuaccucacagagugcau

SEQ ID NO: 1157 - RNA, 21 nt, artificial
  Oligomer
gaccuauggaaacuacuuccu

SEQ ID NO: 1158 - RNA, 21 nt, artificial
  Oligomer
ugcaauaggugugcgucagaa

SEQ ID NO: 1159 - RNA, 21 nt, artificial
  Oligomer
gccauuuuggguuuugggucu

SEQ ID NO: 1160 - RNA, 21 nt, artificial
  Oligomer
agacugacauucuccacuucu

SEQ ID NO: 1161 - RNA, 21 nt, artificial
  Oligomer
aaacucauguucaagacagaa

SEQ ID NO: 1162 - RNA, 21 nt, artificial
  Oligomer
aaaacucauguucaagacaga

SEQ ID NO: 1163 - RNA, 21 nt, artificial
  Oligomer
ucaggaaacauuuucagaccu

SEQ ID NO: 1164 - RNA, 21 nt, artificial
  Oligomer
acaacuacauguguaacaguu

SEQ ID NO: 1165 - RNA, 21 nt, artificial
  Oligomer
uggcucugacuguaccaccau

SEQ ID NO: 1166 - RNA, 21 nt, artificial
  Oligomer
ugagguuggcucugacuguac

SEQ ID NO: 1167 - RNA, 21 nt, artificial
  Oligomer
aguuuugagcuucucaaaagu

SEQ ID NO: 1168 - RNA, 21 nt, artificial
  Oligomer
gccaucuacaagcagucacag

SEQ ID NO: 1169 - RNA, 21 nt, artificial
  Oligomer
cgauauugaacaaugguucac

SEQ ID NO: 1170 - RNA, 21 nt, artificial
  Oligomer
gcaagcacaucugcauuuuca

SEQ ID NO: 1171 - RNA, 21 nt, artificial
  Oligomer
gcaauggaugauuugaugcug

SEQ ID NO: 1172 - RNA, 21 nt, artificial
  Oligomer
ucccaagcaauggaugauuug

SEQ ID NO: 1173 - RNA, 21 nt, artificial
  Oligomer
ccuuaguaccuaaaaggaaau

SEQ ID NO: 1174 - RNA, 21 nt, artificial
  Oligomer
gaccuuaguaccuaaaaggaa

SEQ ID NO: 1175 - RNA, 21 nt, artificial
  Oligomer
cgaccuuaguaccuaaaagga

SEQ ID NO: 1176 - RNA, 21 nt, artificial
  Oligomer
ggucgaccuuaguaccuaaaa

SEQ ID NO: 1177 - RNA, 21 nt, artificial
  Oligomer
uuggucgaccuuaguaccuaa

SEQ ID NO: 1178 - RNA, 21 nt, artificial
  Oligomer
agccaaacccugucugacaac

SEQ ID NO: 1179 - RNA, 21 nt, artificial
  Oligomer
ucuggccuugaaaccaccuuu

SEQ ID NO: 1180 - RNA, 21 nt, artificial
  Oligomer
gaagcugucccucauguugaa

SEQ ID NO: 1181 - RNA, 21 nt, artificial
  Oligomer
ccacuucaccguacuaaccag

SEQ ID NO: 1182 - RNA, 21 nt, artificial
  Oligomer
cacccaggacuuccauuugcu

SEQ ID NO: 1183 - RNA, 21 nt, artificial
  Oligomer
cccugccauuuuggguuuugg

SEQ ID NO: 1184 - RNA, 21 nt, artificial
  Oligomer
ucaagacagaagggccugacu

SEQ ID NO: 1185 - RNA, 21 nt, artificial
  Oligomer
accacuggauggagaauauuu

SEQ ID NO: 1186 - RNA, 21 nt, artificial
  Oligomer
agaagaaaccacuggauggag

SEQ ID NO: 1187 - RNA, 21 nt, artificial
  Oligomer
ugugcucaagacuggcgcuaa

SEQ ID NO: 1188 - RNA, 21 nt, artificial
  Oligomer
gcacagaggaagagaaucucc

SEQ ID NO: 1189 - RNA, 21 nt, artificial
  Oligomer
uccagugguaaucuacuggga

SEQ ID NO: 1190 - RNA, 21 nt, artificial
  Oligomer
cuggaagacuccagugguaau

SEQ ID NO: 1191 - RNA, 21 nt, artificial
  Oligomer
ccucaccaucaucacacugga

SEQ ID NO: 1192 - RNA, 21 nt, artificial
  Oligomer
ccucagcaucuuauccgagug

SEQ ID NO: 1193 - RNA, 21 nt, artificial
  Oligomer
accaugagcgcugcucagaua

SEQ ID NO: 1194 - RNA, 21 nt, artificial
  Oligomer
acaagcagucacagcacauga

SEQ ID NO: 1195 - RNA, 21 nt, artificial
  Oligomer
ggacagccaagucugugacuu

SEQ ID NO: 1196 - RNA, 21 nt, artificial
  Oligomer
uggcgcuaaaaguuuugagcu

SEQ ID NO: 1197 - RNA, 21 nt, artificial
  Oligomer
acgauauugaacaaugguuca

SEQ ID NO: 1198 - RNA, 21 nt, artificial
  Oligomer
gacgauauugaacaaugguuc

SEQ ID NO: 1199 - RNA, 21 nt, artificial
  Oligomer
auccaccaagacuuguuuuau

SEQ ID NO: 1200 - RNA, 21 nt, artificial
  Oligomer
uccugaaaacaacguucuguc

SEQ ID NO: 1201 - RNA, 21 nt, artificial
  Oligomer
cuggccuugaaaccaccuuuu

SEQ ID NO: 1202 - RNA, 21 nt, artificial
  Oligomer
ugggucuuugaacccuugcuu

SEQ ID NO: 1203 - RNA, 21 nt, artificial
  Oligomer
agcuuugaggugcguguuugu

SEQ ID NO: 1204 - RNA, 21 nt, artificial
  Oligomer
acuggaagacuccagugguaa

SEQ ID NO: 1205 - RNA, 21 nt, artificial
  Oligomer
cagcuguggguugauuccaca

SEQ ID NO: 1206 - RNA, 21 nt, artificial
  Oligomer
ggcuucuugcauucugggaca

SEQ ID NO: 1207 - RNA, 21 nt, artificial
  Oligomer
uggauccaccaagacuuguuu

SEQ ID NO: 1208 - RNA, 21 nt, artificial
  Oligomer
uggucgaccuuaguaccuaaa

SEQ ID NO: 1209 - RNA, 21 nt, artificial
  Oligomer
accucuuggucgaccuuagua

SEQ ID NO: 1210 - RNA, 21 nt, artificial
  Oligomer
gguaguuucuacaguugggca

SEQ ID NO: 1211 - RNA, 21 nt, artificial
  Oligomer
ggaagcugucccucauguuga

SEQ ID NO: 1212 - RNA, 21 nt, artificial
  Oligomer
gccugcacugguguuuuguug

SEQ ID NO: 1213 - RNA, 21 nt, artificial
  Oligomer
cugaacaaguuggccugcacu

SEQ ID NO: 1214 - RNA, 21 nt, artificial
  Oligomer
gaacccuugcuugcaauaggu

SEQ ID NO: 1215 - RNA, 21 nt, artificial
  Oligomer
gggucuuugaacccuugcuug

SEQ ID NO: 1216 - RNA, 21 nt, artificial
  Oligomer
guuuugggucuuugaacccuu

SEQ ID NO: 1217 - RNA, 21 nt, artificial
  Oligomer
acacuggaagacuccaguggu

SEQ ID NO: 1218 - RNA, 21 nt, artificial
  Oligomer
uccacuacaacuacaugugua

SEQ ID NO: 1219 - RNA, 21 nt, artificial
  Oligomer
agguuggcucugacuguacca

SEQ ID NO: 1220 - RNA, 21 nt, artificial
  Oligomer
ucagcaucuuauccgagugga

SEQ ID NO: 1221 - RNA, 21 nt, artificial
  Oligomer
ccuccucagcaucuuauccga

SEQ ID NO: 1222 - RNA, 21 nt, artificial
  Oligomer
cugcaagcacaucugcauuuu

SEQ ID NO: 1223 - RNA, 21 nt, artificial
  Oligomer
acccuggaggauuucaucucu

SEQ ID NO: 1224 - RNA, 21 nt, artificial
  Oligomer
cccaagcaauggaugauuuga

SEQ ID NO: 1225 - RNA, 21 nt, artificial
  Oligomer
cuacaguugggcagcugguua

SEQ ID NO: 1226 - RNA, 21 nt, artificial
  Oligomer
ccucacagagugcauugugag

SEQ ID NO: 1227 - RNA, 21 nt, artificial
  Oligomer
ucaccguacuaaccagggaag

SEQ ID NO: 1228 - RNA, 21 nt, artificial
  Oligomer
acugaacaaguuggccugcac

SEQ ID NO: 1229 - RNA, 21 nt, artificial
  Oligomer
cagccaccugaaguccaaaaa

SEQ ID NO: 1230 - RNA, 21 nt, artificial
  Oligomer
cagccaaagaagaaaccacug

SEQ ID NO: 1231 - RNA, 21 nt, artificial
  Oligomer
acagcuuugaggugcguguuu

SEQ ID NO: 1232 - RNA, 21 nt, artificial
  Oligomer
cacuggaagacuccaguggua

SEQ ID NO: 1233 - RNA, 21 nt, artificial
  Oligomer
ucacacuggaagacuccagug

SEQ ID NO: 1234 - RNA, 21 nt, artificial
  Oligomer
cacuacaacuacauguguaac

SEQ ID NO: 1235 - RNA, 21 nt, artificial
  Oligomer
cucugacuguaccaccaucca

SEQ ID NO: 1236 - RNA, 21 nt, artificial
  Oligomer
agucugugacuugcacguacu

SEQ ID NO: 1237 - RNA, 21 nt, artificial
  Oligomer
ccaagucugugacuugcacgu

SEQ ID NO: 1238 - RNA, 21 nt, artificial
  Oligomer
gacagccaagucugugacuug

SEQ ID NO: 1239 - RNA, 21 nt, artificial
  Oligomer
guccagaugaagcucccagaa

SEQ ID NO: 1240 - RNA, 21 nt, artificial
  Oligomer
ugguucacugaagacccaggu

SEQ ID NO: 1241 - RNA, 21 nt, artificial
  Oligomer
agcuggaagggucaacaucuu

SEQ ID NO: 1242 - RNA, 21 nt, artificial
  Oligomer
accuuaguaccuaaaaggaaa

SEQ ID NO: 1243 - RNA, 21 nt, artificial
  Oligomer
ccugucugacaaccucuuggu

SEQ ID NO: 1244 - RNA, 21 nt, artificial
  Oligomer
cacagagugcauugugagggu

SEQ ID NO: 1245 - RNA, 21 nt, artificial
  Oligomer
cuuugaacccuugcuugcaau

SEQ ID NO: 1246 - RNA, 21 nt, artificial
  Oligomer
ccagccaccugaaguccaaaa

SEQ ID NO: 1247 - RNA, 21 nt, artificial
  Oligomer
cuacauguguaacaguuccug

SEQ ID NO: 1248 - RNA, 21 nt, artificial
  Oligomer
ccauccacuacaacuacaugu

SEQ ID NO: 1249 - RNA, 21 nt, artificial
  Oligomer
gagcuucucaaaagucuagag

SEQ ID NO: 1250 - RNA, 21 nt, artificial
  Oligomer
ugagcuucucaaaagucuaga

SEQ ID NO: 1251 - RNA, 21 nt, artificial
  Oligomer
cccuugcuugcaauaggugug

SEQ ID NO: 1252 - RNA, 21 nt, artificial
  Oligomer
ggguuuugggucuuugaaccc

SEQ ID NO: 1253 - RNA, 21 nt, artificial
  Oligomer
accauccacuacaacuacaug

SEQ ID NO: 1254 - RNA, 21 nt, artificial
  Oligomer
ugacaaccucuuggucgaccu

SEQ ID NO: 1255 - RNA, 21 nt, artificial
  Oligomer
uccagccaccugaaguccaaa

SEQ ID NO: 1256 - RNA, 21 nt, artificial
  Oligomer
gaggccuuggaacucaaggau

SEQ ID NO: 1257 - RNA, 21 nt, artificial
  Oligomer
uccagaugaagcucccagaau

SEQ ID NO: 1258 - RNA, 21 nt, artificial
  Oligomer
ugcaagcacaucugcauuuuc

SEQ ID NO: 1259 - RNA, 21 nt, artificial
  Oligomer
gaaugaggccuuggaacucaa

SEQ ID NO: 1260 - RNA, 21 nt, artificial
  Oligomer
gaaaccaccuuuuauuacaug

SEQ ID NO: 1261 - RNA, 21 nt, artificial
  Oligomer
cuacugggacggaacagcuuu

SEQ ID NO: 1262 - RNA, 21 nt, artificial
  Oligomer
ggagauguaagaaauguucuu

SEQ ID NO: 1263 - RNA, 21 nt, artificial
  Oligomer
cuggauccaccaagacuuguu

SEQ ID NO: 1264 - RNA, 21 nt, artificial
  Oligomer
ccucugagucaggaaacauuu

SEQ ID NO: 1265 - RNA, 21 nt, artificial
  Oligomer
ccauggccaucuacaagcagu

SEQ ID NO: 1266 - RNA, 21 nt, artificial
  Oligomer
cguacuaaccagggaagcugu

SEQ ID NO: 1267 - RNA, 21 nt, artificial
  Oligomer
cccucugagucaggaaacauu

SEQ ID NO: 1268 - RNA, 21 nt, artificial
  Oligomer
uccgucugggcuucuugcauu

SEQ ID NO: 1269 - RNA, 21 nt, artificial
  Oligomer
gagauguaagaaauguucuug

SEQ ID NO: 1270 - RNA, 21 nt, artificial
  Oligomer
gauguaagaaauguucuugca

SEQ ID NO: 1271 - RNA, 21 nt, artificial
  Oligomer
aaaccuuaaaaucuaagcugg

SEQ ID NO: 1272 - RNA, 21 nt, artificial
  Oligomer
agagaucgauauaaaaauggg

SEQ ID NO: 1273 - RNA, 21 nt, artificial
  Oligomer
aaaaucuaagcugguaugucc

SEQ ID NO: 1274 - RNA, 21 nt, artificial
  Oligomer
gagaucgauauaaaaauggga

SEQ ID NO: 1275 - RNA, 21 nt, artificial
  Oligomer
aaaugggauauaaaaagggag

SEQ ID NO: 1276 - RNA, 21 nt, artificial
  Oligomer
uuucauuaacccucacaaugc

SEQ ID NO: 1277 - RNA, 21 nt, artificial
  Oligomer
aagacccaaaacccaaaaugg

SEQ ID NO: 1278 - RNA, 21 nt, artificial
  Oligomer
aagggacagaagaugacaggg

SEQ ID NO: 1279 - RNA, 21 nt, artificial
  Oligomer
cauauacaagagaugaaaucc

SEQ ID NO: 1280 - RNA, 21 nt, artificial
  Oligomer
uagagaaaauucaacaugagg

SEQ ID NO: 1281 - RNA, 21 nt, artificial
  Oligomer
uuguaaacuaacccuuaacug

SEQ ID NO: 1282 - RNA, 21 nt, artificial
  Oligomer
uaaaaucuaagcugguauguc

SEQ ID NO: 1283 - RNA, 21 nt, artificial
  Oligomer
ugguagguuuucugggaaggg

SEQ ID NO: 1284 - RNA, 21 nt, artificial
  Oligomer
auccagaucaucauauacaag

SEQ ID NO: 1285 - RNA, 21 nt, artificial
  Oligomer
aacguuguuuucaggaaguag

SEQ ID NO: 1286 - RNA, 21 nt, artificial
  Oligomer
agcauuucacagauaugggcc

SEQ ID NO: 1287 - RNA, 21 nt, artificial
  Oligomer
auaugggccuugaaguuagag

SEQ ID NO: 1288 - RNA, 21 nt, artificial
  Oligomer
aaauucaacaugagggacagc

SEQ ID NO: 1289 - RNA, 21 nt, artificial
  Oligomer
aauguggcugauuguaaacua

SEQ ID NO: 1290 - RNA, 21 nt, artificial
  Oligomer
cauaggucugaaaauguuucc

SEQ ID NO: 1291 - RNA, 21 nt, artificial
  Oligomer
caaaacaucuuguugagggca

SEQ ID NO: 1292 - RNA, 21 nt, artificial
  Oligomer
agaauguaaaagauguugacc

SEQ ID NO: 1293 - RNA, 21 nt, artificial
  Oligomer
aauguaaaagauguugacccu

SEQ ID NO: 1294 - RNA, 21 nt, artificial
  Oligomer
auuaacccucacaaugcacuc

SEQ ID NO: 1295 - RNA, 21 nt, artificial
  Oligomer
agaauguggcugauuguaaac

SEQ ID NO: 1296 - RNA, 21 nt, artificial
  Oligomer
uggcugauuguaaacuaaccc

SEQ ID NO: 1297 - RNA, 21 nt, artificial
  Oligomer
uuucugucauccaaauacucc

SEQ ID NO: 1298 - RNA, 21 nt, artificial
  Oligomer
cauuauuucauuaacccucac

SEQ ID NO: 1299 - RNA, 21 nt, artificial
  Oligomer
ucauuaacccucacaaugcac

SEQ ID NO: 1300 - RNA, 21 nt, artificial
  Oligomer
auguggcugauuguaaacuaa

SEQ ID NO: 1301 - RNA, 21 nt, artificial
  Oligomer
cuuaacugcaagaacauuucu

SEQ ID NO: 1302 - RNA, 21 nt, artificial
  Oligomer
uuuccauaggucugaaaaugu

SEQ ID NO: 1303 - RNA, 21 nt, artificial
  Oligomer
aaguggagaaugucagucuga

SEQ ID NO: 1304 - RNA, 21 nt, artificial
  Oligomer
auaggucugaaaauguuuccu

SEQ ID NO: 1305 - RNA, 21 nt, artificial
  Oligomer
cauuguucaauaucguccggg

SEQ ID NO: 1306 - RNA, 21 nt, artificial
  Oligomer
gcauaaaacaagucuuggugg

SEQ ID NO: 1307 - RNA, 21 nt, artificial
  Oligomer
cagaucaucauauacaagaga

SEQ ID NO: 1308 - RNA, 21 nt, artificial
  Oligomer
uaauaaaaggugguuucaagg

SEQ ID NO: 1309 - RNA, 21 nt, artificial
  Oligomer
uucauuaacccucacaaugca

SEQ ID NO: 1310 - RNA, 21 nt, artificial
  Oligomer
agaaaauucaacaugagggac

SEQ ID NO: 1311 - RNA, 21 nt, artificial
  Oligomer
aaaauucaacaugagggacag

SEQ ID NO: 1312 - RNA, 21 nt, artificial
  Oligomer
uguaaacuaacccuuaacugc

SEQ ID NO: 1313 - RNA, 21 nt, artificial
  Oligomer
gaagggacagaagaugacagg

SEQ ID NO: 1314 - RNA, 21 nt, artificial
  Oligomer
aaccauuguucaauaucgucc

SEQ ID NO: 1315 - RNA, 21 nt, artificial
  Oligomer
accauuguucaauaucguccg

SEQ ID NO: 1316 - RNA, 21 nt, artificial
  Oligomer
aaugggauauaaaaagggaga

SEQ ID NO: 1317 - RNA, 21 nt, artificial
  Oligomer
ugcagaauguaaaagauguug

SEQ ID NO: 1318 - RNA, 21 nt, artificial
  Oligomer
cagaauguaaaagauguugac

SEQ ID NO: 1319 - RNA, 21 nt, artificial
  Oligomer
aauaaaaggugguuucaaggc

SEQ ID NO: 1320 - RNA, 21 nt, artificial
  Oligomer
cagcauuucacagauaugggc

SEQ ID NO: 1321 - RNA, 21 nt, artificial
  Oligomer
uuguuuucaggaaguaguuuc

SEQ ID NO: 1322 - RNA, 21 nt, artificial
  Oligomer
cugauuguaaacuaacccuua

SEQ ID NO: 1323 - RNA, 21 nt, artificial
  Oligomer
agaaugucagucugagucagg

SEQ ID NO: 1324 - RNA, 21 nt, artificial
  Oligomer
uucagcucucggaacaucucg

SEQ ID NO: 1325 - RNA, 21 nt, artificial
  Oligomer
guuccgucccaguagauuacc

SEQ ID NO: 1326 - RNA, 21 nt, artificial
  Oligomer
uccacacgcaaauuuccuucc

SEQ ID NO: 1327 - RNA, 21 nt, artificial
  Oligomer
ccauuguucaauaucguccgg

SEQ ID NO: 1328 - RNA, 21 nt, artificial
  Oligomer
gaauguaaaagauguugaccc

SEQ ID NO: 1329 - RNA, 21 nt, artificial
  Oligomer
guaaaagauguugacccuucc

SEQ ID NO: 1330 - RNA, 21 nt, artificial
  Oligomer
uaaaagauguugacccuucca

SEQ ID NO: 1331 - RNA, 21 nt, artificial
  Oligomer
agcauaaaacaagucuuggug

SEQ ID NO: 1332 - RNA, 21 nt, artificial
  Oligomer
agaaacuaccaacccaccagc

SEQ ID NO: 1333 - RNA, 21 nt, artificial
  Oligomer
uaacccucacaaugcacucug

SEQ ID NO: 1334 - RNA, 21 nt, artificial
  Oligomer
ccuugaaguuagagaaaauuc

SEQ ID NO: 1335 - RNA, 21 nt, artificial
  Oligomer
agagaaaauucaacaugaggg

SEQ ID NO: 1336 - RNA, 21 nt, artificial
  Oligomer
gagaaaauucaacaugaggga

SEQ ID NO: 1337 - RNA, 21 nt, artificial
  Oligomer
aaguaguuuccauaggucuga

SEQ ID NO: 1338 - RNA, 21 nt, artificial
  Oligomer
ucauccaaauacuccacacgc

SEQ ID NO: 1339 - RNA, 21 nt, artificial
  Oligomer
auacuccacacgcaaauuucc

SEQ ID NO: 1340 - RNA, 21 nt, artificial
  Oligomer
auguaaaagauguugacccuu

SEQ ID NO: 1341 - RNA, 21 nt, artificial
  Oligomer
cagcaagacuugacaacuccc

SEQ ID NO: 1342 - RNA, 21 nt, artificial
  Oligomer
uuaacccucacaaugcacucu

SEQ ID NO: 1343 - RNA, 21 nt, artificial
  Oligomer
aacccucacaaugcacucugu

SEQ ID NO: 1344 - RNA, 21 nt, artificial
  Oligomer
auuucacagauaugggccuug

SEQ ID NO: 1345 - RNA, 21 nt, artificial
  Oligomer
uacaucucccaaacaucccuc

SEQ ID NO: 1346 - RNA, 21 nt, artificial
  Oligomer
aaagacccaaaacccaaaaug

SEQ ID NO: 1347 - RNA, 21 nt, artificial
  Oligomer
aacaagaaguggagaauguca

SEQ ID NO: 1348 - RNA, 21 nt, artificial
  Oligomer
ugaaauauucuccauccagug

SEQ ID NO: 1349 - RNA, 21 nt, artificial
  Oligomer
auguaguuguaguggauggug

SEQ ID NO: 1350 - RNA, 21 nt, artificial
  Oligomer
guuucugucauccaaauacuc

SEQ ID NO: 1351 - RNA, 21 nt, artificial
  Oligomer
aauacuccacacgcaaauuuc

SEQ ID NO: 1352 - RNA, 21 nt, artificial
  Oligomer
caaaacuuuuagcgccagucu

SEQ ID NO: 1353 - RNA, 21 nt, artificial
  Oligomer
augggauauaaaaagggagaa

SEQ ID NO: 1354 - RNA, 21 nt, artificial
  Oligomer
gcagaauguaaaagauguuga

SEQ ID NO: 1355 - RNA, 21 nt, artificial
  Oligomer
aacuuuuagcgccagucuuga

SEQ ID NO: 1356 - RNA, 21 nt, artificial
  Oligomer
uuucacagauaugggccuuga

SEQ ID NO: 1357 - RNA, 21 nt, artificial
  Oligomer
aagaaguggagaaugucaguc

SEQ ID NO: 1358 - RNA, 21 nt, artificial
  Oligomer
gaaguggagaaugucagucug

SEQ ID NO: 1359 - RNA, 21 nt, artificial
  Oligomer
agauucucuuccucugugcgc

SEQ ID NO: 1360 - RNA, 21 nt, artificial
  Oligomer
uuccgucccaguagauuacca

SEQ ID NO: 1361 - RNA, 21 nt, artificial
  Oligomer
uccgucccaguagauuaccac

SEQ ID NO: 1362 - RNA, 21 nt, artificial
  Oligomer
ucugucauccaaauacuccac

SEQ ID NO: 1363 - RNA, 21 nt, artificial
  Oligomer
acgcaaauuuccuuccacucg

SEQ ID NO: 1364 - RNA, 21 nt, artificial
  Oligomer
acaaccuccgucaugugcugu

SEQ ID NO: 1365 - RNA, 21 nt, artificial
  Oligomer
aaacuuuuagcgccagucuug

SEQ ID NO: 1366 - RNA, 21 nt, artificial
  Oligomer
caucaaaucauccauugcuug

SEQ ID NO: 1367 - RNA, 21 nt, artificial
  Oligomer
aaacuaccaacccaccagcca

SEQ ID NO: 1368 - RNA, 21 nt, artificial
  Oligomer
auucaacaugagggacagcuu

SEQ ID NO: 1369 - RNA, 21 nt, artificial
  Oligomer
aaacuaacccuuaacugcaag

SEQ ID NO: 1370 - RNA, 21 nt, artificial
  Oligomer
aacauuucuuacaucucccaa

SEQ ID NO: 1371 - RNA, 21 nt, artificial
  Oligomer
auuucuuacaucucccaaaca

SEQ ID NO: 1372 - RNA, 21 nt, artificial
  Oligomer
ucuuacaucucccaaacaucc

SEQ ID NO: 1373 - RNA, 21 nt, artificial
  Oligomer
acaacaaaacaccagugcagg

SEQ ID NO: 1374 - RNA, 21 nt, artificial
  Oligomer
uccauaggucugaaaauguuu

SEQ ID NO: 1375 - RNA, 21 nt, artificial
  Oligomer
gaacaagaaguggagaauguc

SEQ ID NO: 1376 - RNA, 21 nt, artificial
  Oligomer
cauucagcucucggaacaucu

SEQ ID NO: 1377 - RNA, 21 nt, artificial
  Oligomer
uguuucugucauccaaauacu

SEQ ID NO: 1378 - RNA, 21 nt, artificial
  Oligomer
cuccacacgcaaauuuccuuc

SEQ ID NO: 1379 - RNA, 21 nt, artificial
  Oligomer
acagcaucaaaucauccauug

SEQ ID NO: 1380 - RNA, 21 nt, artificial
  Oligomer
ccagcaagacuugacaacucc

SEQ ID NO: 1381 - RNA, 21 nt, artificial
  Oligomer
agacuugacaacucccucuac

SEQ ID NO: 1382 - RNA, 21 nt, artificial
  Oligomer
aacucccucuaccuaaccagc

SEQ ID NO: 1383 - RNA, 21 nt, artificial
  Oligomer
aggccagauguacauuauuuc

SEQ ID NO: 1384 - RNA, 21 nt, artificial
  Oligomer
ggccagauguacauuauuuca

SEQ ID NO: 1385 - RNA, 21 nt, artificial
  Oligomer
uucuuacaucucccaaacauc

SEQ ID NO: 1386 - RNA, 21 nt, artificial
  Oligomer
cuuacaucucccaaacauccc

SEQ ID NO: 1387 - RNA, 21 nt, artificial
  Oligomer
acaucucccaaacaucccuca

SEQ ID NO: 1388 - RNA, 21 nt, artificial
  Oligomer
caucucccaaacaucccucac

SEQ ID NO: 1389 - RNA, 21 nt, artificial
  Oligomer
caagaaguggagaaugucagu

SEQ ID NO: 1390 - RNA, 21 nt, artificial
  Oligomer
auucagcucucggaacaucuc

SEQ ID NO: 1391 - RNA, 21 nt, artificial
  Oligomer
cauccagugguuucuucuuug

SEQ ID NO: 1392 - RNA, 21 nt, artificial
  Oligomer
uucugucauccaaauacucca

SEQ ID NO: 1393 - RNA, 21 nt, artificial
  Oligomer
ugucauccaaauacuccacac

SEQ ID NO: 1394 - RNA, 21 nt, artificial
  Oligomer
gucauccaaauacuccacacg

SEQ ID NO: 1395 - RNA, 21 nt, artificial
  Oligomer
cacacgcaaauuuccuuccac

SEQ ID NO: 1396 - RNA, 21 nt, artificial
  Oligomer
aaaagauguugacccuuccag

SEQ ID NO: 1397 - RNA, 21 nt, artificial
  Oligomer
aacuaacccuuaacugcaaga

SEQ ID NO: 1398 - RNA, 21 nt, artificial
  Oligomer
gaacauuucuuacaucuccca

SEQ ID NO: 1399 - RNA, 21 nt, artificial
  Oligomer
uuacaucucccaaacaucccu

SEQ ID NO: 1400 - RNA, 21 nt, artificial
  Oligomer
cccacaacaaaacaccagugc

SEQ ID NO: 1401 - RNA, 21 nt, artificial
  Oligomer
uguaguuguaguggauggugg

SEQ ID NO: 1402 - RNA, 21 nt, artificial
  Oligomer
uacuccacacgcaaauuuccu

SEQ ID NO: 1403 - RNA, 21 nt, artificial
  Oligomer
aacaugaguuuuuuauggcgg

SEQ ID NO: 1404 - RNA, 21 nt, artificial
  Oligomer
acugacccuuuuuggacuuca

SEQ ID NO: 1405 - RNA, 21 nt, artificial
  Oligomer
acgguggcucuagacuuuuga

SEQ ID NO: 1406 - RNA, 21 nt, artificial
  Oligomer
uaugucgaaaaguguuucugu

SEQ ID NO: 1407 - RNA, 21 nt, artificial
  Oligomer
gacaacucccucuaccuaacc

SEQ ID NO: 1408 - RNA, 21 nt, artificial
  Oligomer
uuucaaggccagauguacauu

SEQ ID NO: 1409 - RNA, 21 nt, artificial
  Oligomer
gacugacccuuuuuggacuuc

SEQ ID NO: 1410 - RNA, 21 nt, artificial
  Oligomer
guaguuguaguggaugguggu

SEQ ID NO: 1411 - RNA, 21 nt, artificial
  Oligomer
cugucccagaaugcaagaagc

SEQ ID NO: 1412 - RNA, 21 nt, artificial
  Oligomer
caacuguagaaacuaccaacc

SEQ ID NO: 1413 - RNA, 21 nt, artificial
  Oligomer
aacuguagaaacuaccaaccc

SEQ ID NO: 1414 - RNA, 21 nt, artificial
  Oligomer
uaagcugguauguccuacucc

SEQ ID NO: 1415 - RNA, 21 nt, artificial
  Oligomer
caaauggaaguccugggugcu

SEQ ID NO: 1416 - RNA, 21 nt, artificial
  Oligomer
aacaucuuguugagggcaggg

SEQ ID NO: 1417 - RNA, 21 nt, artificial
  Oligomer
caacucccucuaccuaaccag

SEQ ID NO: 1418 - RNA, 21 nt, artificial
  Oligomer
cugugagguaggugcaaaugc

SEQ ID NO: 1419 - RNA, 21 nt, artificial
  Oligomer
ugaacaugaguuuuuuauggc

SEQ ID NO: 1420 - RNA, 21 nt, artificial
  Oligomer
gaacaugaguuuuuuauggcg

SEQ ID NO: 1421 - RNA, 21 nt, artificial
  Oligomer
cuuuuuggacuucagguggcu

SEQ ID NO: 1422 - RNA, 21 nt, artificial
  Oligomer
ugugaugauggugaggauggg

SEQ ID NO: 1423 - RNA, 21 nt, artificial
  Oligomer
gugugaugauggugaggaugg

SEQ ID NO: 1424 - RNA, 21 nt, artificial
  Oligomer
gaagcucaaaacuuuuagcgc

SEQ ID NO: 1425 - RNA, 21 nt, artificial
  Oligomer
caagagguugucagacagggu

SEQ ID NO: 1426 - RNA, 21 nt, artificial
  Oligomer
ugucgaaaaguguuucuguca

SEQ ID NO: 1427 - RNA, 21 nt, artificial
  Oligomer
aagcucaaaacuuuuagcgcc

SEQ ID NO: 1428 - RNA, 21 nt, artificial
  Oligomer
auacaagagaugaaauccucc

SEQ ID NO: 1429 - RNA, 21 nt, artificial
  Oligomer
agaacauuucuuacaucuccc

SEQ ID NO: 1430 - RNA, 21 nt, artificial
  Oligomer
cugaagggugaaauauucucc

SEQ ID NO: 1431 - RNA, 21 nt, artificial
  Oligomer
uuucuugcggagauucucuuc

SEQ ID NO: 1432 - RNA, 21 nt, artificial
  Oligomer
aaagcuggacagucgccauga

SEQ ID NO: 1433 - RNA, 21 nt, artificial
  Oligomer
uauaaaaagggagaaggaggg

SEQ ID NO: 1434 - RNA, 21 nt, artificial
  Oligomer
aagagaugaaauccuccaggg

SEQ ID NO: 1435 - RNA, 21 nt, artificial
  Oligomer
uucaggaaguaguuuccauag

SEQ ID NO: 1436 - RNA, 21 nt, artificial
  Oligomer
aacaucccucacaguaaaaac

SEQ ID NO: 1437 - RNA, 21 nt, artificial
  Oligomer
augaguuuuuuauggcgggag

SEQ ID NO: 1438 - RNA, 21 nt, artificial
  Oligomer
aucugaagggugaaauauucu

SEQ ID NO: 1439 - RNA, 21 nt, artificial
  Oligomer
auucuccauccagugguuucu

SEQ ID NO: 1440 - RNA, 21 nt, artificial
  Oligomer
uugcggagauucucuuccucu

SEQ ID NO: 1441 - RNA, 21 nt, artificial
  Oligomer
augucgaaaaguguuucuguc

SEQ ID NO: 1442 - RNA, 21 nt, artificial
  Oligomer
augugcugugacugcuuguag

SEQ ID NO: 1443 - RNA, 21 nt, artificial
  Oligomer
aaacaucuuguugagggcagg

SEQ ID NO: 1444 - RNA, 21 nt, artificial
  Oligomer
auauaaaaagggagaaggagg

SEQ ID NO: 1445 - RNA, 21 nt, artificial
  Oligomer
uggauccagaucaucauauac

SEQ ID NO: 1446 - RNA, 21 nt, artificial
  Oligomer
cuaccuaccuagaauguggcu

SEQ ID NO: 1447 - RNA, 21 nt, artificial
  Oligomer
aacugcaagaacauuucuuac

SEQ ID NO: 1448 - RNA, 21 nt, artificial
  Oligomer
caucccucacaguaaaaaccu

SEQ ID NO: 1449 - RNA, 21 nt, artificial
  Oligomer
aaccuuaaaaucuaagcuggu

SEQ ID NO: 1450 - RNA, 21 nt, artificial
  Oligomer
aaaucuaagcugguauguccu

SEQ ID NO: 1451 - RNA, 21 nt, artificial
  Oligomer
aucuaagcugguauguccuac

SEQ ID NO: 1452 - RNA, 21 nt, artificial
  Oligomer
acaaagcaaauggaaguccug

SEQ ID NO: 1453 - RNA, 21 nt, artificial
  Oligomer
ugaguuuuuuauggcgggagg

SEQ ID NO: 1454 - RNA, 21 nt, artificial
  Oligomer
agguagacugacccuuuuugg

SEQ ID NO: 1455 - RNA, 21 nt, artificial
  Oligomer
uuacacauguaguuguagugg

SEQ ID NO: 1456 - RNA, 21 nt, artificial
  Oligomer
cuaugucgaaaaguguuucug

SEQ ID NO: 1457 - RNA, 21 nt, artificial
  Oligomer
accuaccuagaauguggcuga

SEQ ID NO: 1458 - RNA, 21 nt, artificial
  Oligomer
caaagcaaauggaaguccugg

SEQ ID NO: 1459 - RNA, 21 nt, artificial
  Oligomer
aaagcaaauggaaguccuggg

SEQ ID NO: 1460 - RNA, 21 nt, artificial
  Oligomer
uuuagcgccagucuugagcac

SEQ ID NO: 1461 - RNA, 21 nt, artificial
  Oligomer
uuuuuauggcgggagguagac

SEQ ID NO: 1462 - RNA, 21 nt, artificial
  Oligomer
ugacccuuuuuggacuucagg

SEQ ID NO: 1463 - RNA, 21 nt, artificial
  Oligomer
uucuugcggagauucucuucc

SEQ ID NO: 1464 - RNA, 21 nt, artificial
  Oligomer
ucuuccagugugaugauggug

SEQ ID NO: 1465 - RNA, 21 nt, artificial
  Oligomer
uuccagugugaugauggugag

SEQ ID NO: 1466 - RNA, 21 nt, artificial
  Oligomer
agaagcucaaaacuuuuagcg

SEQ ID NO: 1467 - RNA, 21 nt, artificial
  Oligomer
uauacaagagaugaaauccuc

SEQ ID NO: 1468 - RNA, 21 nt, artificial
  Oligomer
aaaucauccauugcuugggac

SEQ ID NO: 1469 - RNA, 21 nt, artificial
  Oligomer
agguaggugcaaaugccagca

SEQ ID NO: 1470 - RNA, 21 nt, artificial
  Oligomer
uguuuucaggaaguaguuucc

SEQ ID NO: 1471 - RNA, 21 nt, artificial
  Oligomer
uaccuaccuagaauguggcug

SEQ ID NO: 1472 - RNA, 21 nt, artificial
  Oligomer
ggacaaagcaaauggaagucc

SEQ ID NO: 1473 - RNA, 21 nt, artificial
  Oligomer
cuucugacgcacaccuauugc

SEQ ID NO: 1474 - RNA, 21 nt, artificial
  Oligomer
aaugucagucugagucaggcc

SEQ ID NO: 1475 - RNA, 21 nt, artificial
  Oligomer
acaugaguuuuuuauggcggg

SEQ ID NO: 1476 - RNA, 21 nt, artificial
  Oligomer
cugaaaauguuuccugacuca

SEQ ID NO: 1477 - RNA, 21 nt, artificial
  Oligomer
aagggugaaauauucuccauc

SEQ ID NO: 1478 - RNA, 21 nt, artificial
  Oligomer
auauucuccauccagugguuu

SEQ ID NO: 1479 - RNA, 21 nt, artificial
  Oligomer
agugguuucuucuuuggcugg

SEQ ID NO: 1480 - RNA, 21 nt, artificial
  Oligomer
acuaugucgaaaaguguuucu

SEQ ID NO: 1481 - RNA, 21 nt, artificial
  Oligomer
aguuggcaaaacaucuuguug

SEQ ID NO: 1482 - RNA, 21 nt, artificial
  Oligomer
uuggcaaaacaucuuguugag

SEQ ID NO: 1483 - RNA, 21 nt, artificial
  Oligomer
cuguagaaacuaccaacccac

SEQ ID NO: 1484 - RNA, 21 nt, artificial
  Oligomer
accuagaauguggcugauugu

SEQ ID NO: 1485 - RNA, 21 nt, artificial
  Oligomer
aacaaaacaccagugcaggcc

SEQ ID NO: 1486 - RNA, 21 nt, artificial
  Oligomer
uuuuagcgccagucuugagca

SEQ ID NO: 1487 - RNA, 21 nt, artificial
  Oligomer
uaggucugaaaauguuuccug

SEQ ID NO: 1488 - RNA, 21 nt, artificial
  Oligomer
uuuauggcgggagguagacug

SEQ ID NO: 1489 - RNA, 21 nt, artificial
  Oligomer
cccuuuuuggacuucaggugg

SEQ ID NO: 1490 - RNA, 21 nt, artificial
  Oligomer
ucugaaaauguuuccugacuc

SEQ ID NO: 1491 - RNA, 21 nt, artificial
  Oligomer
ugaaaauguuuccugacucag

SEQ ID NO: 1492 - RNA, 21 nt, artificial
  Oligomer
agggugaaauauucuccaucc

SEQ ID NO: 1493 - RNA, 21 nt, artificial
  Oligomer
aaaauguuuccugacucagag

SEQ ID NO: 1494 - RNA, 21 nt, artificial
  Oligomer
auccagugguuucuucuuugg

SEQ ID NO: 1495 - RNA, 21 nt, artificial
  Oligomer
cuugcggagauucucuuccuc

SEQ ID NO: 1496 - RNA, 21 nt, artificial
  Oligomer
agauuaccacuggagucuucc

SEQ ID NO: 1497 - RNA, 21 nt, artificial
  Oligomer
agucuuccagugugaugaugg

SEQ ID NO: 1498 - RNA, 21 nt, artificial
  Oligomer
cgaaaaguguuucugucaucc

SEQ ID NO: 1499 - RNA, 21 nt, artificial
  Oligomer
ccaguuggcaaaacaucuugu

SEQ ID NO: 1500 - RNA, 21 nt, artificial
  Oligomer
uggcaaaacaucuuguugagg

SEQ ID NO: 1501 - RNA, 21 nt, artificial
  Oligomer
aaaacaucuuguugagggcag

SEQ ID NO: 1502 - RNA, 21 nt, artificial
  Oligomer
gucuucagugaaccauuguuc

SEQ ID NO: 1503 - RNA, 21 nt, artificial
  Oligomer
acaagagaugaaauccuccag

SEQ ID NO: 1504 - RNA, 21 nt, artificial
  Oligomer
caagagaugaaauccuccagg

SEQ ID NO: 1505 - RNA, 21 nt, artificial
  Oligomer
augaaauccuccagggugugg

SEQ ID NO: 1506 - RNA, 21 nt, artificial
  Oligomer
aaucauccauugcuugggacg

SEQ ID NO: 1507 - RNA, 21 nt, artificial
  Oligomer
uugucagacaggguuuggcug

SEQ ID NO: 1508 - RNA, 21 nt, artificial
  Oligomer
ugguuaguacggugaaguggg

SEQ ID NO: 1509 - RNA, 21 nt, artificial
  Oligomer
gacaaagcaaauggaaguccu

SEQ ID NO: 1510 - RNA, 21 nt, artificial
  Oligomer
uuauggcgggagguagacuga

SEQ ID NO: 1511 - RNA, 21 nt, artificial
  Oligomer
ugaagggugaaauauucucca

SEQ ID NO: 1512 - RNA, 21 nt, artificial
  Oligomer
aauauucuccauccagugguu

SEQ ID NO: 1513 - RNA, 21 nt, artificial
  Oligomer
gucccaguagauuaccacugg

SEQ ID NO: 1514 - RNA, 21 nt, artificial
  Oligomer
cacuaugucgaaaaguguuuc

SEQ ID NO: 1515 - RNA, 21 nt, artificial
  Oligomer
gaaaaguguuucugucaucca

SEQ ID NO: 1516 - RNA, 21 nt, artificial
  Oligomer
auuuccuuccacucggauaag

SEQ ID NO: 1517 - RNA, 21 nt, artificial
  Oligomer
gcaaaacaucuuguugagggc

SEQ ID NO: 1518 - RNA, 21 nt, artificial
  Oligomer
ugcaagucacagacuuggcug

SEQ ID NO: 1519 - RNA, 21 nt, artificial
  Oligomer
uacaagagaugaaauccucca

SEQ ID NO: 1520 - RNA, 21 nt, artificial
  Oligomer
gugagguaggugcaaaugcca

SEQ ID NO: 1521 - RNA, 21 nt, artificial
  Oligomer
aacaugagggacagcuucccu

SEQ ID NO: 1522 - RNA, 21 nt, artificial
  Oligomer
guuuucaggaaguaguuucca

SEQ ID NO: 1523 - RNA, 21 nt, artificial
  Oligomer
caggaaguaguuuccauaggu

SEQ ID NO: 1524 - RNA, 21 nt, artificial
  Oligomer
acaaaacaccagugcaggcca

SEQ ID NO: 1525 - RNA, 21 nt, artificial
  Oligomer
auggaaguccugggugcuucu

SEQ ID NO: 1526 - RNA, 21 nt, artificial
  Oligomer
uagauuaccacuggagucuuc

SEQ ID NO: 1527 - RNA, 21 nt, artificial
  Oligomer
augcaggaacuguuacacaug

SEQ ID NO: 1528 - RNA, 21 nt, artificial
  Oligomer
ugugacugcuuguagauggcc

SEQ ID NO: 1529 - RNA, 21 nt, artificial
  Oligomer
uagcugcccugguagguuuuc

SEQ ID NO: 1530 - RNA, 21 nt, artificial
  Oligomer
uuuucugggaagggacagaag

SEQ ID NO: 1531 - RNA, 21 nt, artificial
  Oligomer
cugggaagggacagaagauga

SEQ ID NO: 1532 - RNA, 21 nt, artificial
  Oligomer
agguugucagacaggguuugg

SEQ ID NO: 1533 - RNA, 21 nt, artificial
  Oligomer
aucauccauugcuugggacgg

SEQ ID NO: 1534 - RNA, 21 nt, artificial
  Oligomer
uguagaaacuaccaacccacc

SEQ ID NO: 1535 - RNA, 21 nt, artificial
  Oligomer
ugugagguaggugcaaaugcc

SEQ ID NO: 1536 - RNA, 21 nt, artificial
  Oligomer
aaaugccagcauuucacagau

SEQ ID NO: 1537 - RNA, 21 nt, artificial
  Oligomer
ccagcauuucacagauauggg

SEQ ID NO: 1538 - RNA, 21 nt, artificial
  Oligomer
aagcaaauggaaguccugggu

SEQ ID NO: 1539 - RNA, 21 nt, artificial
  Oligomer
uauucuccauccagugguuuc

SEQ ID NO: 1540 - RNA, 21 nt, artificial
  Oligomer
ucuugcggagauucucuuccu

SEQ ID NO: 1541 - RNA, 21 nt, artificial
  Oligomer
gaacuguuacacauguaguug

SEQ ID NO: 1542 - RNA, 21 nt, artificial
  Oligomer
uagggcaccaccacacuaugu

SEQ ID NO: 1543 - RNA, 21 nt, artificial
  Oligomer
agaccaucgcuaucugagcag

SEQ ID NO: 1544 - RNA, 21 nt, artificial
  Oligomer
aaccuccgucaugugcuguga

SEQ ID NO: 1545 - RNA, 21 nt, artificial
  Oligomer
gagaagcucaaaacuuuuagc

SEQ ID NO: 1546 - RNA, 21 nt, artificial
  Oligomer
uucaucuggaccugggucuuc

SEQ ID NO: 1547 - RNA, 21 nt, artificial
  Oligomer
aaagauguugacccuuccagc

SEQ ID NO: 1548 - RNA, 21 nt, artificial
  Oligomer
aaaacaagucuugguggaucc

SEQ ID NO: 1549 - RNA, 21 nt, artificial
  Oligomer
aucaaaucauccauugcuugg

SEQ ID NO: 1550 - RNA, 21 nt, artificial
  Oligomer
auaaaaggugguuucaaggcc

SEQ ID NO: 1551 - RNA, 21 nt, artificial
  Oligomer
caaugcacucugugagguagg

SEQ ID NO: 1552 - RNA, 21 nt, artificial
  Oligomer
ugcaaaugccagcauuucaca

SEQ ID NO: 1553 - RNA, 21 nt, artificial
  Oligomer
ccuaccuaccuagaauguggc

SEQ ID NO: 1554 - RNA, 21 nt, artificial
  Oligomer
cuaagcugguauguccuacuc

SEQ ID NO: 1555 - RNA, 21 nt, artificial
  Oligomer
aagcugguauguccuacuccc

SEQ ID NO: 1556 - RNA, 21 nt, artificial
  Oligomer
caugaguuuuuuauggcggga

SEQ ID NO: 1557 - RNA, 21 nt, artificial
  Oligomer
uuccaaggccucauucagcuc

SEQ ID NO: 1558 - RNA, 21 nt, artificial
  Oligomer
gaaauauucuccauccagugg

SEQ ID NO: 1559 - RNA, 21 nt, artificial
  Oligomer
uucuccauccagugguuucuu

SEQ ID NO: 1560 - RNA, 21 nt, artificial
  Oligomer
uccagugguuucuucuuuggc

SEQ ID NO: 1561 - RNA, 21 nt, artificial
  Oligomer
gagauucucuuccucugugcg

SEQ ID NO: 1562 - RNA, 21 nt, artificial
  Oligomer
cuguuacacauguaguuguag

SEQ ID NO: 1563 - RNA, 21 nt, artificial
  Oligomer
uuguaguggauggugguacag

SEQ ID NO: 1564 - RNA, 21 nt, artificial
  Oligomer
uaguggauggugguacaguca

SEQ ID NO: 1565 - RNA, 21 nt, artificial
  Oligomer
auagggcaccaccacacuaug

SEQ ID NO: 1566 - RNA, 21 nt, artificial
  Oligomer
uuccacucggauaagaugcug

SEQ ID NO: 1567 - RNA, 21 nt, artificial
  Oligomer
ugagaagcucaaaacuuuuag

SEQ ID NO: 1568 - RNA, 21 nt, artificial
  Oligomer
gaguacgugcaagucacagac

SEQ ID NO: 1569 - RNA, 21 nt, artificial
  Oligomer
uacgugcaagucacagacuug

SEQ ID NO: 1570 - RNA, 21 nt, artificial
  Oligomer
agaaugcaagaagcccagacg

SEQ ID NO: 1571 - RNA, 21 nt, artificial
  Oligomer
cauucugggagcuucaucugg

SEQ ID NO: 1572 - RNA, 21 nt, artificial
  Oligomer
ucuucagugaaccauuguuca

SEQ ID NO: 1573 - RNA, 21 nt, artificial
  Oligomer
gugaaaaugcagaugugcuug

SEQ ID NO: 1574 - RNA, 21 nt, artificial
  Oligomer
auguugacccuuccagcucca

SEQ ID NO: 1575 - RNA, 21 nt, artificial
  Oligomer
aaggucgaccaagagguuguc

SEQ ID NO: 1576 - RNA, 21 nt, artificial
  Oligomer
uaaaaggugguuucaaggcca

SEQ ID NO: 1577 - RNA, 21 nt, artificial
  Oligomer
augcacucugugagguaggug

SEQ ID NO: 1578 - RNA, 21 nt, artificial
  Oligomer
aggaaguaguuuccauagguc

SEQ ID NO: 1579 - RNA, 21 nt, artificial
  Oligomer
uucugacgcacaccuauugca

SEQ ID NO: 1580 - RNA, 21 nt, artificial
  Oligomer
agacccaaaacccaaaauggc

SEQ ID NO: 1581 - RNA, 21 nt, artificial
  Oligomer
agaaguggagaaugucagucu

SEQ ID NO: 1582 - RNA, 21 nt, artificial
  Oligomer
uucugucuugaacaugaguuu

SEQ ID NO: 1583 - RNA, 21 nt, artificial
  Oligomer
ucugucuugaacaugaguuuu

SEQ ID NO: 1584 - RNA, 21 nt, artificial
  Oligomer
aggucugaaaauguuuccuga

SEQ ID NO: 1585 - RNA, 21 nt, artificial
  Oligomer
aacuguuacacauguaguugu

SEQ ID NO: 1586 - RNA, 21 nt, artificial
  Oligomer
auggugguacagucagagcca

SEQ ID NO: 1587 - RNA, 21 nt, artificial
  Oligomer
guacagucagagccaaccuca

SEQ ID NO: 1588 - RNA, 21 nt, artificial
  Oligomer
acuuuugagaagcucaaaacu

SEQ ID NO: 1589 - RNA, 21 nt, artificial
  Oligomer
cugugacugcuuguagauggc

SEQ ID NO: 1590 - RNA, 21 nt, artificial
  Oligomer
gugaaccauuguucaauaucg

SEQ ID NO: 1591 - RNA, 21 nt, artificial
  Oligomer
ugaaaaugcagaugugcuugc

SEQ ID NO: 1592 - RNA, 21 nt, artificial
  Oligomer
cagcaucaaaucauccauugc

SEQ ID NO: 1593 - RNA, 21 nt, artificial
  Oligomer
caaaucauccauugcuuggga

SEQ ID NO: 1594 - RNA, 21 nt, artificial
  Oligomer
auuuccuuuuagguacuaagg

SEQ ID NO: 1595 - RNA, 21 nt, artificial
  Oligomer
uuccuuuuagguacuaagguc

SEQ ID NO: 1596 - RNA, 21 nt, artificial
  Oligomer
uccuuuuagguacuaaggucg

SEQ ID NO: 1597 - RNA, 21 nt, artificial
  Oligomer
uuuuagguacuaaggucgacc

SEQ ID NO: 1598 - RNA, 21 nt, artificial
  Oligomer
uuagguacuaaggucgaccaa

SEQ ID NO: 1599 - RNA, 21 nt, artificial
  Oligomer
guugucagacaggguuuggcu

SEQ ID NO: 1600 - RNA, 21 nt, artificial
  Oligomer
aaaggugguuucaaggccaga

SEQ ID NO: 1601 - RNA, 21 nt, artificial
  Oligomer
uucaacaugagggacagcuuc

SEQ ID NO: 1602 - RNA, 21 nt, artificial
  Oligomer
cugguuaguacggugaagugg

SEQ ID NO: 1603 - RNA, 21 nt, artificial
  Oligomer
agcaaauggaaguccugggug

SEQ ID NO: 1604 - RNA, 21 nt, artificial
  Oligomer
ccaaaacccaaaauggcaggg

SEQ ID NO: 1605 - RNA, 21 nt, artificial
  Oligomer
agucaggcccuucugucuuga

SEQ ID NO: 1606 - RNA, 21 nt, artificial
  Oligomer
aaauauucuccauccaguggu

SEQ ID NO: 1607 - RNA, 21 nt, artificial
  Oligomer
cuccauccagugguuucuucu

SEQ ID NO: 1608 - RNA, 21 nt, artificial
  Oligomer
uuagcgccagucuugagcaca

SEQ ID NO: 1609 - RNA, 21 nt, artificial
  Oligomer
ggagauucucuuccucugugc

SEQ ID NO: 1610 - RNA, 21 nt, artificial
  Oligomer
ucccaguagauuaccacugga

SEQ ID NO: 1611 - RNA, 21 nt, artificial
  Oligomer
auuaccacuggagucuuccag

SEQ ID NO: 1612 - RNA, 21 nt, artificial
  Oligomer
uccagugugaugauggugagg

SEQ ID NO: 1613 - RNA, 21 nt, artificial
  Oligomer
cacucggauaagaugcugagg

SEQ ID NO: 1614 - RNA, 21 nt, artificial
  Oligomer
uaucugagcagcgcucauggu

SEQ ID NO: 1615 - RNA, 21 nt, artificial
  Oligomer
ucaugugcugugacugcuugu

SEQ ID NO: 1616 - RNA, 21 nt, artificial
  Oligomer
aagucacagacuuggcugucc

SEQ ID NO: 1617 - RNA, 21 nt, artificial
  Oligomer
agcucaaaacuuuuagcgcca

SEQ ID NO: 1618 - RNA, 21 nt, artificial
  Oligomer
ugaaccauuguucaauaucgu

SEQ ID NO: 1619 - RNA, 21 nt, artificial
  Oligomer
gaaccauuguucaauaucguc

SEQ ID NO: 1620 - RNA, 21 nt, artificial
  Oligomer
auaaaacaagucuugguggau

SEQ ID NO: 1621 - RNA, 21 nt, artificial
  Oligomer
gacagaacguuguuuucagga

SEQ ID NO: 1622 - RNA, 21 nt, artificial
  Oligomer
aaaaggugguuucaaggccag

SEQ ID NO: 1623 - RNA, 21 nt, artificial
  Oligomer
aagcaaggguucaaagaccca

SEQ ID NO: 1624 - RNA, 21 nt, artificial
  Oligomer
acaaacacgcaccucaaagcu

SEQ ID NO: 1625 - RNA, 21 nt, artificial
  Oligomer
uuaccacuggagucuuccagu

SEQ ID NO: 1626 - RNA, 21 nt, artificial
  Oligomer
uguggaaucaacccacagcug

SEQ ID NO: 1627 - RNA, 21 nt, artificial
  Oligomer
ugucccagaaugcaagaagcc

SEQ ID NO: 1628 - RNA, 21 nt, artificial
  Oligomer
aaacaagucuugguggaucca

SEQ ID NO: 1629 - RNA, 21 nt, artificial
  Oligomer
uuuagguacuaaggucgacca

SEQ ID NO: 1630 - RNA, 21 nt, artificial
  Oligomer
uacuaaggucgaccaagaggu

SEQ ID NO: 1631 - RNA, 21 nt, artificial
  Oligomer
ugcccaacuguagaaacuacc

SEQ ID NO: 1632 - RNA, 21 nt, artificial
  Oligomer
ucaacaugagggacagcuucc

SEQ ID NO: 1633 - RNA, 21 nt, artificial
  Oligomer
caacaaaacaccagugcaggc

SEQ ID NO: 1634 - RNA, 21 nt, artificial
  Oligomer
agugcaggccaacuuguucag

SEQ ID NO: 1635 - RNA, 21 nt, artificial
  Oligomer
accuauugcaagcaaggguuc

SEQ ID NO: 1636 - RNA, 21 nt, artificial
  Oligomer
caagcaaggguucaaagaccc

SEQ ID NO: 1637 - RNA, 21 nt, artificial
  Oligomer
aaggguucaaagacccaaaac

SEQ ID NO: 1638 - RNA, 21 nt, artificial
  Oligomer
accacuggagucuuccagugu

SEQ ID NO: 1639 - RNA, 21 nt, artificial
  Oligomer
uacacauguaguuguagugga

SEQ ID NO: 1640 - RNA, 21 nt, artificial
  Oligomer
ugguacagucagagccaaccu

SEQ ID NO: 1641 - RNA, 21 nt, artificial
  Oligomer
uccacucggauaagaugcuga

SEQ ID NO: 1642 - RNA, 21 nt, artificial
  Oligomer
ucggauaagaugcugaggagg

SEQ ID NO: 1643 - RNA, 21 nt, artificial
  Oligomer
aaaaugcagaugugcuugcag

SEQ ID NO: 1644 - RNA, 21 nt, artificial
  Oligomer
agagaugaaauccuccagggu

SEQ ID NO: 1645 - RNA, 21 nt, artificial
  Oligomer
ucaaaucauccauugcuuggg

SEQ ID NO: 1646 - RNA, 21 nt, artificial
  Oligomer
uaaccagcugcccaacuguag

SEQ ID NO: 1647 - RNA, 21 nt, artificial
  Oligomer
cucacaaugcacucugugagg

SEQ ID NO: 1648 - RNA, 21 nt, artificial
  Oligomer
cuucccugguuaguacgguga

SEQ ID NO: 1649 - RNA, 21 nt, artificial
  Oligomer
gugcaggccaacuuguucagu

SEQ ID NO: 1650 - RNA, 21 nt, artificial
  Oligomer
uuuuuggacuucagguggcug

SEQ ID NO: 1651 - RNA, 21 nt, artificial
  Oligomer
cagugguuucuucuuuggcug

SEQ ID NO: 1652 - RNA, 21 nt, artificial
  Oligomer
aaacacgcaccucaaagcugu

SEQ ID NO: 1653 - RNA, 21 nt, artificial
  Oligomer
uaccacuggagucuuccagug

SEQ ID NO: 1654 - RNA, 21 nt, artificial
  Oligomer
cacuggagucuuccaguguga

SEQ ID NO: 1655 - RNA, 21 nt, artificial
  Oligomer
guuacacauguaguuguagug

SEQ ID NO: 1656 - RNA, 21 nt, artificial
  Oligomer
uggauggugguacagucagag

SEQ ID NO: 1657 - RNA, 21 nt, artificial
  Oligomer
aguacgugcaagucacagacu

SEQ ID NO: 1658 - RNA, 21 nt, artificial
  Oligomer
acgugcaagucacagacuugg

SEQ ID NO: 1659 - RNA, 21 nt, artificial
  Oligomer
caagucacagacuuggcuguc

SEQ ID NO: 1660 - RNA, 21 nt, artificial
  Oligomer
uucugggagcuucaucuggac

SEQ ID NO: 1661 - RNA, 21 nt, artificial
  Oligomer
accugggucuucagugaacca

SEQ ID NO: 1662 - RNA, 21 nt, artificial
  Oligomer
aagauguugacccuuccagcu

SEQ ID NO: 1663 - RNA, 21 nt, artificial
  Oligomer
uuuccuuuuagguacuaaggu

SEQ ID NO: 1664 - RNA, 21 nt, artificial
  Oligomer
accaagagguugucagacagg

SEQ ID NO: 1665 - RNA, 21 nt, artificial
  Oligomer
acccucacaaugcacucugug

SEQ ID NO: 1666 - RNA, 21 nt, artificial
  Oligomer
auugcaagcaaggguucaaag

SEQ ID NO: 1667 - RNA, 21 nt, artificial
  Oligomer
uuuuggacuucagguggcugg

SEQ ID NO: 1668 - RNA, 21 nt, artificial
  Oligomer
caggaacuguuacacauguag

SEQ ID NO: 1669 - RNA, 21 nt, artificial
  Oligomer
acauguaguuguaguggaugg

SEQ ID NO: 1670 - RNA, 21 nt, artificial
  Oligomer
cucuagacuuuugagaagcuc

SEQ ID NO: 1671 - RNA, 21 nt, artificial
  Oligomer
ucuagacuuuugagaagcuca

SEQ ID NO: 1672 - RNA, 21 nt, artificial
  Oligomer
cacaccuauugcaagcaaggg

SEQ ID NO: 1673 - RNA, 21 nt, artificial
  Oligomer
ggguucaaagacccaaaaccc

SEQ ID NO: 1674 - RNA, 21 nt, artificial
  Oligomer
cauguaguuguaguggauggu

SEQ ID NO: 1675 - RNA, 21 nt, artificial
  Oligomer
aggucgaccaagagguuguca

SEQ ID NO: 1676 - RNA, 21 nt, artificial
  Oligomer
uuuggacuucagguggcugga

SEQ ID NO: 1677 - RNA, 21 nt, artificial
  Oligomer
auccuugaguuccaaggccuc

SEQ ID NO: 1678 - RNA, 21 nt, artificial
  Oligomer
auucugggagcuucaucugga

SEQ ID NO: 1679 - RNA, 21 nt, artificial
  Oligomer
gaaaaugcagaugugcuugca

SEQ ID NO: 1680 - RNA, 21 nt, artificial
  Oligomer
uugaguuccaaggccucauuc

SEQ ID NO: 1681 - RNA, 21 nt, artificial
  Oligomer
cauguaauaaaaggugguuuc

SEQ ID NO: 1682 - RNA, 21 nt, artificial
  Oligomer
aaagcuguuccgucccaguag

SEQ ID NO: 1683 - RNA, 21 nt, artificial
  Oligomer
aagaacauuucuuacaucucc

SEQ ID NO: 1684 - RNA, 21 nt, artificial
  Oligomer
aacaagucuugguggauccag

SEQ ID NO: 1685 - RNA, 21 nt, artificial
  Oligomer
aaauguuuccugacucagagg

SEQ ID NO: 1686 - RNA, 21 nt, artificial
  Oligomer
acugcuuguagauggccaugg

SEQ ID NO: 1687 - RNA, 21 nt, artificial
  Oligomer
acagcuucccugguuaguacg

SEQ ID NO: 1688 - RNA, 21 nt, artificial
  Oligomer
aauguuuccugacucagaggg

SEQ ID NO: 1689 - RNA, 21 nt, artificial
  Oligomer
aaugcaagaagcccagacgga

SEQ ID NO: 1690 - RNA, 21 nt, artificial
  Oligomer
caagaacauuucuuacaucuc

SEQ ID NO: 1691 - RNA, 21 nt, artificial
  Oligomer
ugcaagaacauuucuuacauc

SEQ ID NO: 1692 - RNA, 19 nt, artificial
  Oligomer
ccgagacagaggguuaaau

SEQ ID NO: 1693 - RNA, 19 nt, artificial
  Oligomer
gaaucacagaaacacuuuu

SEQ ID NO: 1694 - RNA, 19 nt, artificial
  Oligomer
ggccuggugaugugauuuu

SEQ ID NO: 1695 - RNA, 19 nt, artificial
  Oligomer
gugaugugauuuuggccau

SEQ ID NO: 1696 - RNA, 19 nt, artificial
  Oligomer
ccguggucuauaucgagau

SEQ ID NO: 1697 - RNA, 19 nt, artificial
  Oligomer
ugacauggguuucuuggua

SEQ ID NO: 1698 - RNA, 19 nt, artificial
  Oligomer
agggugaaaacuucugcuu

SEQ ID NO: 1699 - RNA, 19 nt, artificial
  Oligomer
ugaagaaucacagaaacac

SEQ ID NO: 1700 - RNA, 19 nt, artificial
  Oligomer
ugaagcuguucgaacccaa

SEQ ID NO: 1701 - RNA, 19 nt, artificial
  Oligomer
gacauggguuucuugguaa

SEQ ID NO: 1702 - RNA, 19 nt, artificial
  Oligomer
cgguugcugacauggguuu

SEQ ID NO: 1703 - RNA, 19 nt, artificial
  Oligomer
ggugaaaacuucugcuuga

SEQ ID NO: 1704 - RNA, 19 nt, artificial
  Oligomer
ccuagcaacauauuauagu

SEQ ID NO: 1705 - RNA, 19 nt, artificial
  Oligomer
accgagacagaggguuaaa

SEQ ID NO: 1706 - RNA, 19 nt, artificial
  Oligomer
gccuggugaugugauuuug

SEQ ID NO: 1707 - RNA, 19 nt, artificial
  Oligomer
gguaagcuccugagguaau

SEQ ID NO: 1708 - RNA, 19 nt, artificial
  Oligomer
gggugaaaacuucugcuug

SEQ ID NO: 1709 - RNA, 19 nt, artificial
  Oligomer
cugcucugauuuccuccuu

SEQ ID NO: 1710 - RNA, 19 nt, artificial
  Oligomer
ggugaugugauuuuggcca

SEQ ID NO: 1711 - RNA, 19 nt, artificial
  Oligomer
gccguggucuauaucgaga

SEQ ID NO: 1712 - RNA, 19 nt, artificial
  Oligomer
gugaaaacuucugcuugac

SEQ ID NO: 1713 - RNA, 19 nt, artificial
  Oligomer
agauguuuaugaagcuguu

SEQ ID NO: 1714 - RNA, 19 nt, artificial
  Oligomer
ggagcagaugguacaaaau

SEQ ID NO: 1715 - RNA, 19 nt, artificial
  Oligomer
ugaaggucacagcuggaau

SEQ ID NO: 1716 - RNA, 19 nt, artificial
  Oligomer
cguggucuauaucgagauc

SEQ ID NO: 1717 - RNA, 19 nt, artificial
  Oligomer
guaagcuccugagguaaug

SEQ ID NO: 1718 - RNA, 19 nt, artificial
  Oligomer
uggguuucuugguaagcuc

SEQ ID NO: 1719 - RNA, 19 nt, artificial
  Oligomer
acauggguuucuugguaag

SEQ ID NO: 1720 - RNA, 19 nt, artificial
  Oligomer
ccaucuuuugugggcaguu

SEQ ID NO: 1721 - RNA, 19 nt, artificial
  Oligomer
cugauuuccuccuugccuu

SEQ ID NO: 1722 - RNA, 19 nt, artificial
  Oligomer
cacugaccuuauaugugac

SEQ ID NO: 1723 - RNA, 19 nt, artificial
  Oligomer
gcagaugguacaaaaugcu

SEQ ID NO: 1724 - RNA, 19 nt, artificial
  Oligomer
cggccuggugaugugauuu

SEQ ID NO: 1725 - RNA, 19 nt, artificial
  Oligomer
ugaaaacuucugcuugaca

SEQ ID NO: 1726 - RNA, 19 nt, artificial
  Oligomer
gagggugaaaacuucugcu

SEQ ID NO: 1727 - RNA, 19 nt, artificial
  Oligomer
ggagggugaaaacuucugc

SEQ ID NO: 1728 - RNA, 19 nt, artificial
  Oligomer
accauccugaccuccuauu

SEQ ID NO: 1729 - RNA, 19 nt, artificial
  Oligomer
gaaggagggugaaaacuuc

SEQ ID NO: 1730 - RNA, 19 nt, artificial
  Oligomer
ugaaggagggugaaaacuu

SEQ ID NO: 1731 - RNA, 19 nt, artificial
  Oligomer
caaaaggcuagagguaaag

SEQ ID NO: 1732 - RNA, 19 nt, artificial
  Oligomer
ugcucugauuuccuccuug

SEQ ID NO: 1733 - RNA, 19 nt, artificial
  Oligomer
ugaugugauuuuggccauu

SEQ ID NO: 1734 - RNA, 19 nt, artificial
  Oligomer
uccuuugccaucccuucug

SEQ ID NO: 1735 - RNA, 19 nt, artificial
  Oligomer
cugccguggucuauaucga

SEQ ID NO: 1736 - RNA, 19 nt, artificial
  Oligomer
ugagugcgguugcugacau

SEQ ID NO: 1737 - RNA, 19 nt, artificial
  Oligomer
caucuuuugugggcaguua

SEQ ID NO: 1738 - RNA, 19 nt, artificial
  Oligomer
gcugcugccaucuuuugug

SEQ ID NO: 1739 - RNA, 19 nt, artificial
  Oligomer
ugauuuccuccuugccuuu

SEQ ID NO: 1740 - RNA, 19 nt, artificial
  Oligomer
ccugcucugauuuccuccu

SEQ ID NO: 1741 - RNA, 19 nt, artificial
  Oligomer
acaucgcaacgcugaggau

SEQ ID NO: 1742 - RNA, 19 nt, artificial
  Oligomer
ugcucuuugugguguggug

SEQ ID NO: 1743 - RNA, 19 nt, artificial
  Oligomer
ugcugcucuuuguggugug

SEQ ID NO: 1744 - RNA, 19 nt, artificial
  Oligomer
gucaggugcugcucuuugu

SEQ ID NO: 1745 - RNA, 19 nt, artificial
  Oligomer
cgagaguuucugcaucgug

SEQ ID NO: 1746 - RNA, 19 nt, artificial
  Oligomer
gugcugcucuuuguggugu

SEQ ID NO: 1747 - RNA, 19 nt, artificial
  Oligomer
ggcagugcuguuguuguug

SEQ ID NO: 1748 - RNA, 19 nt, artificial
  Oligomer
cuccugcucugauuuccuc

SEQ ID NO: 1749 - RNA, 19 nt, artificial
  Oligomer
caaaaugcugaagauguuu

SEQ ID NO: 1750 - RNA, 19 nt, artificial
  Oligomer
gaugguacaaaaugcugaa

SEQ ID NO: 1751 - RNA, 19 nt, artificial
  Oligomer
agaugguacaaaaugcuga

SEQ ID NO: 1752 - RNA, 19 nt, artificial
  Oligomer
agaccacaauucccggcau

SEQ ID NO: 1753 - RNA, 19 nt, artificial
  Oligomer
cccggagucaguacaacuu

SEQ ID NO: 1754 - RNA, 19 nt, artificial
  Oligomer
agaaugaauagaucaccaa

SEQ ID NO: 1755 - RNA, 19 nt, artificial
  Oligomer
ggacgagaaacacugaccu

SEQ ID NO: 1756 - RNA, 19 nt, artificial
  Oligomer
gccucagagaacucuggaa

SEQ ID NO: 1757 - RNA, 19 nt, artificial
  Oligomer
cugcugacgucaggaacuu

SEQ ID NO: 1758 - RNA, 19 nt, artificial
  Oligomer
ugaacaccaugaaggucac

SEQ ID NO: 1759 - RNA, 19 nt, artificial
  Oligomer
cucugaagaaucacagaaa

SEQ ID NO: 1760 - RNA, 19 nt, artificial
  Oligomer
cagugcuguuguuguugug

SEQ ID NO: 1761 - RNA, 19 nt, artificial
  Oligomer
cgcugaggauucagacuaa

SEQ ID NO: 1762 - RNA, 19 nt, artificial
  Oligomer
acgcugaggauucagacua

SEQ ID NO: 1763 - RNA, 19 nt, artificial
  Oligomer
uugcugacauggguuucuu

SEQ ID NO: 1764 - RNA, 19 nt, artificial
  Oligomer
gcucugaagaaucacagaa

SEQ ID NO: 1765 - RNA, 19 nt, artificial
  Oligomer
ccaagaguaugaggcuccu

SEQ ID NO: 1766 - RNA, 19 nt, artificial
  Oligomer
aggucacagaaugaauaga

SEQ ID NO: 1767 - RNA, 19 nt, artificial
  Oligomer
ugguacaaaaugcugaaga

SEQ ID NO: 1768 - RNA, 19 nt, artificial
  Oligomer
ugaugaugcugacccugag

SEQ ID NO: 1769 - RNA, 19 nt, artificial
  Oligomer
gugcacuucugaaggacuu

SEQ ID NO: 1770 - RNA, 19 nt, artificial
  Oligomer
gggaaaagaagaauuccuc

SEQ ID NO: 1771 - RNA, 19 nt, artificial
  Oligomer
ucccaugcuuggcuacaga

SEQ ID NO: 1772 - RNA, 19 nt, artificial
  Oligomer
ccggagucaguacaacuuc

SEQ ID NO: 1773 - RNA, 19 nt, artificial
  Oligomer
aggguuaaaugaaccagug

SEQ ID NO: 1774 - RNA, 19 nt, artificial
  Oligomer
gaggguuaaaugaaccagu

SEQ ID NO: 1775 - RNA, 19 nt, artificial
  Oligomer
caccgagacagaggguuaa

SEQ ID NO: 1776 - RNA, 19 nt, artificial
  Oligomer
ccucagagaacucuggaac

SEQ ID NO: 1777 - RNA, 19 nt, artificial
  Oligomer
ugauuggagugaacaccau

SEQ ID NO: 1778 - RNA, 19 nt, artificial
  Oligomer
uugguaagcuccugaggua

SEQ ID NO: 1779 - RNA, 19 nt, artificial
  Oligomer
ccauagugcauggucugau

SEQ ID NO: 1780 - RNA, 19 nt, artificial
  Oligomer
gggcucugaagaaucacag

SEQ ID NO: 1781 - RNA, 19 nt, artificial
  Oligomer
cuccugggcucugaagaau

SEQ ID NO: 1782 - RNA, 19 nt, artificial
  Oligomer
agaggguuaaaugaaccag

SEQ ID NO: 1783 - RNA, 19 nt, artificial
  Oligomer
gaagauguuuaugaagcug

SEQ ID NO: 1784 - RNA, 19 nt, artificial
  Oligomer
gaaaagaagaauuccuccu

SEQ ID NO: 1785 - RNA, 19 nt, artificial
  Oligomer
ugaucgucuucgagaguuu

SEQ ID NO: 1786 - RNA, 19 nt, artificial
  Oligomer
cugcuugacaguuccacau

SEQ ID NO: 1787 - RNA, 19 nt, artificial
  Oligomer
ugagcugcugccaucuuuu

SEQ ID NO: 1788 - RNA, 19 nt, artificial
  Oligomer
ccaccaaaaggcuagaggu

SEQ ID NO: 1789 - RNA, 19 nt, artificial
  Oligomer
agaucaccaagaguaugag

SEQ ID NO: 1790 - RNA, 19 nt, artificial
  Oligomer
cugaucgucuucgagaguu

SEQ ID NO: 1791 - RNA, 19 nt, artificial
  Oligomer
cccuucugaucgucuucga

SEQ ID NO: 1792 - RNA, 19 nt, artificial
  Oligomer
uuggagugaacaccaugaa

SEQ ID NO: 1793 - RNA, 19 nt, artificial
  Oligomer
guccgugugagacugcuaa

SEQ ID NO: 1794 - RNA, 19 nt, artificial
  Oligomer
acaacuucaucgcagaugu

SEQ ID NO: 1795 - RNA, 19 nt, artificial
  Oligomer
caguacaacuucaucgcag

SEQ ID NO: 1796 - RNA, 19 nt, artificial
  Oligomer
cucugaaggagggugaaaa

SEQ ID NO: 1797 - RNA, 19 nt, artificial
  Oligomer
ccaugcuuggcuacagaua

SEQ ID NO: 1798 - RNA, 19 nt, artificial
  Oligomer
agcaaagauucccaugcuu

SEQ ID NO: 1799 - RNA, 19 nt, artificial
  Oligomer
ugaccuccuauuaaagaaa

SEQ ID NO: 1800 - RNA, 19 nt, artificial
  Oligomer
ucugaagaaucacagaaac

SEQ ID NO: 1801 - RNA, 19 nt, artificial
  Oligomer
uccuugccuuucuggcuga

SEQ ID NO: 1802 - RNA, 19 nt, artificial
  Oligomer
cagaaugaauagaucacca

SEQ ID NO: 1803 - RNA, 19 nt, artificial
  Oligomer
gcugacgucaggaacuucu

SEQ ID NO: 1804 - RNA, 19 nt, artificial
  Oligomer
gcugaagauguuuaugaag

SEQ ID NO: 1805 - RNA, 19 nt, artificial
  Oligomer
ggaagcuccauaacugcug

SEQ ID NO: 1806 - RNA, 19 nt, artificial
  Oligomer
uggucuauaucgagauccu

SEQ ID NO: 1807 - RNA, 19 nt, artificial
  Oligomer
gaaaacuucugcuugacag

SEQ ID NO: 1808 - RNA, 19 nt, artificial
  Oligomer
cccaugcuuggcuacagau

SEQ ID NO: 1809 - RNA, 19 nt, artificial
  Oligomer
ggcucugaagaaucacaga

SEQ ID NO: 1810 - RNA, 19 nt, artificial
  Oligomer
agagaacucuggaacccgu

SEQ ID NO: 1811 - RNA, 19 nt, artificial
  Oligomer
gcacuucugaaggacuuca

SEQ ID NO: 1812 - RNA, 19 nt, artificial
  Oligomer
ccucugaaggagggugaaa

SEQ ID NO: 1813 - RNA, 19 nt, artificial
  Oligomer
gaaaaugagcugcugccau

SEQ ID NO: 1814 - RNA, 19 nt, artificial
  Oligomer
ccuccuauuaaagaaaaug

SEQ ID NO: 1815 - RNA, 19 nt, artificial
  Oligomer
ugggcucugaagaaucaca

SEQ ID NO: 1816 - RNA, 19 nt, artificial
  Oligomer
cagaggguuaaaugaacca

SEQ ID NO: 1817 - RNA, 19 nt, artificial
  Oligomer
agaauuccuccuccggaau

SEQ ID NO: 1818 - RNA, 19 nt, artificial
  Oligomer
aagaauuccuccuccggaa

SEQ ID NO: 1819 - RNA, 19 nt, artificial
  Oligomer
cuggaaucuccuuugccau

SEQ ID NO: 1820 - RNA, 19 nt, artificial
  Oligomer
ccacauccauagugcaugg

SEQ ID NO: 1821 - RNA, 19 nt, artificial
  Oligomer
gcaaagauucccaugcuug

SEQ ID NO: 1822 - RNA, 19 nt, artificial
  Oligomer
gagcaaagauucccaugcu

SEQ ID NO: 1823 - RNA, 19 nt, artificial
  Oligomer
gccaucuuuugugggcagu

SEQ ID NO: 1824 - RNA, 19 nt, artificial
  Oligomer
cugaccuccuauuaaagaa

SEQ ID NO: 1825 - RNA, 19 nt, artificial
  Oligomer
cacagaaugaauagaucac

SEQ ID NO: 1826 - RNA, 19 nt, artificial
  Oligomer
cccugaggucacagaauga

SEQ ID NO: 1827 - RNA, 19 nt, artificial
  Oligomer
ugccaucccuucugaucgu

SEQ ID NO: 1828 - RNA, 19 nt, artificial
  Oligomer
ggcuacagauacugacagc

SEQ ID NO: 1829 - RNA, 19 nt, artificial
  Oligomer
uggcuacagauacugacag

SEQ ID NO: 1830 - RNA, 19 nt, artificial
  Oligomer
ggagcaaagauucccaugc

SEQ ID NO: 1831 - RNA, 19 nt, artificial
  Oligomer
agauacuggagcugaccau

SEQ ID NO: 1832 - RNA, 19 nt, artificial
  Oligomer
agcuccauaacugcugcuu

SEQ ID NO: 1833 - RNA, 19 nt, artificial
  Oligomer
gcugaggauucagacuaag

SEQ ID NO: 1834 - RNA, 19 nt, artificial
  Oligomer
caguuccacauccauagug

SEQ ID NO: 1835 - RNA, 19 nt, artificial
  Oligomer
ugacaguuccacauccaua

SEQ ID NO: 1836 - RNA, 19 nt, artificial
  Oligomer
ugggagcaaagauucccau

SEQ ID NO: 1837 - RNA, 19 nt, artificial
  Oligomer
ugccaucuuuugugggcag

SEQ ID NO: 1838 - RNA, 19 nt, artificial
  Oligomer
augagcugcugccaucuuu

SEQ ID NO: 1839 - RNA, 19 nt, artificial
  Oligomer
gcuagagguaaagcuguau

SEQ ID NO: 1840 - RNA, 19 nt, artificial
  Oligomer
caccaaaaggcuagaggua

SEQ ID NO: 1841 - RNA, 19 nt, artificial
  Oligomer
cacuucugaaggacuucag

SEQ ID NO: 1842 - RNA, 19 nt, artificial
  Oligomer
caucccuucugaucgucuu

SEQ ID NO: 1843 - RNA, 19 nt, artificial
  Oligomer
ccaucccuucugaucgucu

SEQ ID NO: 1844 - RNA, 19 nt, artificial
  Oligomer
ggaaucuccuuugccaucc

SEQ ID NO: 1845 - RNA, 19 nt, artificial
  Oligomer
gugaacaccaugaagguca

SEQ ID NO: 1846 - RNA, 19 nt, artificial
  Oligomer
ugggcucauugucaccaac

SEQ ID NO: 1847 - RNA, 19 nt, artificial
  Oligomer
agauucccaugcuuggcua

SEQ ID NO: 1848 - RNA, 19 nt, artificial
  Oligomer
cugccaucuuuugugggca

SEQ ID NO: 1849 - RNA, 19 nt, artificial
  Oligomer
accaaaaggcuagagguaa

SEQ ID NO: 1850 - RNA, 19 nt, artificial
  Oligomer
ugccuuucuggcugagguu

SEQ ID NO: 1851 - RNA, 19 nt, artificial
  Oligomer
gcucugauuuccuccuugc

SEQ ID NO: 1852 - RNA, 19 nt, artificial
  Oligomer
augggcucauugucaccaa

SEQ ID NO: 1853 - RNA, 19 nt, artificial
  Oligomer
ucaucgcagauguggugga

SEQ ID NO: 1854 - RNA, 19 nt, artificial
  Oligomer
gacaguuccacauccauag

SEQ ID NO: 1855 - RNA, 19 nt, artificial
  Oligomer
gcuacagauacugacagcu

SEQ ID NO: 1856 - RNA, 19 nt, artificial
  Oligomer
caguuagucaggugcugcu

SEQ ID NO: 1857 - RNA, 19 nt, artificial
  Oligomer
gaggcuccugcucugauuu

SEQ ID NO: 1858 - RNA, 19 nt, artificial
  Oligomer
acagcuggaaucuccuuug

SEQ ID NO: 1859 - RNA, 19 nt, artificial
  Oligomer
cacagcuggaaucuccuuu

SEQ ID NO: 1860 - RNA, 19 nt, artificial
  Oligomer
gggagcaaagauucccaug

SEQ ID NO: 1861 - RNA, 19 nt, artificial
  Oligomer
gaccauccugaccuccuau

SEQ ID NO: 1862 - RNA, 19 nt, artificial
  Oligomer
ucgagaguuucugcaucgu

SEQ ID NO: 1863 - RNA, 19 nt, artificial
  Oligomer
ggagugaacaccaugaagg

SEQ ID NO: 1864 - RNA, 19 nt, artificial
  Oligomer
ccugaggucacagaaugaa

SEQ ID NO: 1865 - RNA, 19 nt, artificial
  Oligomer
ucacagcuggaaucuccuu

SEQ ID NO: 1866 - RNA, 19 nt, artificial
  Oligomer
gcuggaaucuccuuugcca

SEQ ID NO: 1867 - RNA, 19 nt, artificial
  Oligomer
gcaacgcugaggauucaga

SEQ ID NO: 1868 - RNA, 19 nt, artificial
  Oligomer
cugaggucacagaaugaau

SEQ ID NO: 1869 - RNA, 19 nt, artificial
  Oligomer
cacauccauagugcauggu

SEQ ID NO: 1870 - RNA, 19 nt, artificial
  Oligomer
cagcuauugauuuuggaaa

SEQ ID NO: 1871 - RNA, 19 nt, artificial
  Oligomer
gcuauugauuuuggaaacu

SEQ ID NO: 1872 - RNA, 19 nt, artificial
  Oligomer
agcuauugauuuuggaaac

SEQ ID NO: 1873 - RNA, 19 nt, artificial
  Oligomer
auuuaacccucugucucgg

SEQ ID NO: 1874 - RNA, 19 nt, artificial
  Oligomer
aaaaguguuucugugauuc

SEQ ID NO: 1875 - RNA, 19 nt, artificial
  Oligomer
aaaaucacaucaccaggcc

SEQ ID NO: 1876 - RNA, 19 nt, artificial
  Oligomer
auggccaaaaucacaucac

SEQ ID NO: 1877 - RNA, 19 nt, artificial
  Oligomer
aucucgauauagaccacgg

SEQ ID NO: 1878 - RNA, 19 nt, artificial
  Oligomer
uaccaagaaacccauguca

SEQ ID NO: 1879 - RNA, 19 nt, artificial
  Oligomer
aagcagaaguuuucacccu

SEQ ID NO: 1880 - RNA, 19 nt, artificial
  Oligomer
guguuucugugauucuuca

SEQ ID NO: 1881 - RNA, 19 nt, artificial
  Oligomer
uuggguucgaacagcuuca

SEQ ID NO: 1882 - RNA, 19 nt, artificial
  Oligomer
uuaccaagaaacccauguc

SEQ ID NO: 1883 - RNA, 19 nt, artificial
  Oligomer
aaacccaugucagcaaccg

SEQ ID NO: 1884 - RNA, 19 nt, artificial
  Oligomer
ucaagcagaaguuuucacc

SEQ ID NO: 1885 - RNA, 19 nt, artificial
  Oligomer
acuauaauauguugcuagg

SEQ ID NO: 1886 - RNA, 19 nt, artificial
  Oligomer
uuuaacccucugucucggu

SEQ ID NO: 1887 - RNA, 19 nt, artificial
  Oligomer
caaaaucacaucaccaggc

SEQ ID NO: 1888 - RNA, 19 nt, artificial
  Oligomer
auuaccucaggagcuuacc

SEQ ID NO: 1889 - RNA, 19 nt, artificial
  Oligomer
caagcagaaguuuucaccc

SEQ ID NO: 1890 - RNA, 19 nt, artificial
  Oligomer
aaggaggaaaucagagcag

SEQ ID NO: 1891 - RNA, 19 nt, artificial
  Oligomer
uggccaaaaucacaucacc

SEQ ID NO: 1892 - RNA, 19 nt, artificial
  Oligomer
ucucgauauagaccacggc

SEQ ID NO: 1893 - RNA, 19 nt, artificial
  Oligomer
gucaagcagaaguuuucac

SEQ ID NO: 1894 - RNA, 19 nt, artificial
  Oligomer
aacagcuucauaaacaucu

SEQ ID NO: 1895 - RNA, 19 nt, artificial
  Oligomer
auuuuguaccaucugcucc

SEQ ID NO: 1896 - RNA, 19 nt, artificial
  Oligomer
auuccagcugugaccuuca

SEQ ID NO: 1897 - RNA, 19 nt, artificial
  Oligomer
gaucucgauauagaccacg

SEQ ID NO: 1898 - RNA, 19 nt, artificial
  Oligomer
cauuaccucaggagcuuac

SEQ ID NO: 1899 - RNA, 19 nt, artificial
  Oligomer
gagcuuaccaagaaaccca

SEQ ID NO: 1900 - RNA, 19 nt, artificial
  Oligomer
cuuaccaagaaacccaugu

SEQ ID NO: 1901 - RNA, 19 nt, artificial
  Oligomer
aacugcccacaaaagaugg

SEQ ID NO: 1902 - RNA, 19 nt, artificial
  Oligomer
aaggcaaggaggaaaucag

SEQ ID NO: 1903 - RNA, 19 nt, artificial
  Oligomer
gucacauauaaggucagug

SEQ ID NO: 1904 - RNA, 19 nt, artificial
  Oligomer
agcauuuuguaccaucugc

SEQ ID NO: 1905 - RNA, 19 nt, artificial
  Oligomer
aaaucacaucaccaggccg

SEQ ID NO: 1906 - RNA, 19 nt, artificial
  Oligomer
ugucaagcagaaguuuuca

SEQ ID NO: 1907 - RNA, 19 nt, artificial
  Oligomer
agcagaaguuuucacccuc

SEQ ID NO: 1908 - RNA, 19 nt, artificial
  Oligomer
gcagaaguuuucacccucc

SEQ ID NO: 1909 - RNA, 19 nt, artificial
  Oligomer
aauaggaggucaggauggu

SEQ ID NO: 1910 - RNA, 19 nt, artificial
  Oligomer
gaaguuuucacccuccuuc

SEQ ID NO: 1911 - RNA, 19 nt, artificial
  Oligomer
aaguuuucacccuccuuca

SEQ ID NO: 1912 - RNA, 19 nt, artificial
  Oligomer
cuuuaccucuagccuuuug

SEQ ID NO: 1913 - RNA, 19 nt, artificial
  Oligomer
caaggaggaaaucagagca

SEQ ID NO: 1914 - RNA, 19 nt, artificial
  Oligomer
aauggccaaaaucacauca

SEQ ID NO: 1915 - RNA, 19 nt, artificial
  Oligomer
cagaagggauggcaaagga

SEQ ID NO: 1916 - RNA, 19 nt, artificial
  Oligomer
ucgauauagaccacggcag

SEQ ID NO: 1917 - RNA, 19 nt, artificial
  Oligomer
augucagcaaccgcacuca

SEQ ID NO: 1918 - RNA, 19 nt, artificial
  Oligomer
uaacugcccacaaaagaug

SEQ ID NO: 1919 - RNA, 19 nt, artificial
  Oligomer
cacaaaagauggcagcagc

SEQ ID NO: 1920 - RNA, 19 nt, artificial
  Oligomer
aaaggcaaggaggaaauca

SEQ ID NO: 1921 - RNA, 19 nt, artificial
  Oligomer
aggaggaaaucagagcagg

SEQ ID NO: 1922 - RNA, 19 nt, artificial
  Oligomer
auccucagcguugcgaugu

SEQ ID NO: 1923 - RNA, 19 nt, artificial
  Oligomer
caccacaccacaaagagca

SEQ ID NO: 1924 - RNA, 19 nt, artificial
  Oligomer
cacaccacaaagagcagca

SEQ ID NO: 1925 - RNA, 19 nt, artificial
  Oligomer
acaaagagcagcaccugac

SEQ ID NO: 1926 - RNA, 19 nt, artificial
  Oligomer
cacgaugcagaaacucucg

SEQ ID NO: 1927 - RNA, 19 nt, artificial
  Oligomer
acaccacaaagagcagcac

SEQ ID NO: 1928 - RNA, 19 nt, artificial
  Oligomer
caacaacaacagcacugcc

SEQ ID NO: 1929 - RNA, 19 nt, artificial
  Oligomer
gaggaaaucagagcaggag

SEQ ID NO: 1930 - RNA, 19 nt, artificial
  Oligomer
aaacaucuucagcauuuug

SEQ ID NO: 1931 - RNA, 19 nt, artificial
  Oligomer
uucagcauuuuguaccauc

SEQ ID NO: 1932 - RNA, 19 nt, artificial
  Oligomer
ucagcauuuuguaccaucu

SEQ ID NO: 1933 - RNA, 19 nt, artificial
  Oligomer
augccgggaauuguggucu

SEQ ID NO: 1934 - RNA, 19 nt, artificial
  Oligomer
aaguuguacugacuccggg

SEQ ID NO: 1935 - RNA, 19 nt, artificial
  Oligomer
uuggugaucuauucauucu

SEQ ID NO: 1936 - RNA, 19 nt, artificial
  Oligomer
aggucaguguuucucgucc

SEQ ID NO: 1937 - RNA, 19 nt, artificial
  Oligomer
uuccagaguucucugaggc

SEQ ID NO: 1938 - RNA, 19 nt, artificial
  Oligomer
aaguuccugacgucagcag

SEQ ID NO: 1939 - RNA, 19 nt, artificial
  Oligomer
gugaccuucaugguguuca

SEQ ID NO: 1940 - RNA, 19 nt, artificial
  Oligomer
uuucugugauucuucagag

SEQ ID NO: 1941 - RNA, 19 nt, artificial
  Oligomer
cacaacaacaacagcacug

SEQ ID NO: 1942 - RNA, 19 nt, artificial
  Oligomer
uuagucugaauccucagcg

SEQ ID NO: 1943 - RNA, 19 nt, artificial
  Oligomer
uagucugaauccucagcgu

SEQ ID NO: 1944 - RNA, 19 nt, artificial
  Oligomer
aagaaacccaugucagcaa

SEQ ID NO: 1945 - RNA, 19 nt, artificial
  Oligomer
uucugugauucuucagagc

SEQ ID NO: 1946 - RNA, 19 nt, artificial
  Oligomer
aggagccucauacucuugg

SEQ ID NO: 1947 - RNA, 19 nt, artificial
  Oligomer
ucuauucauucugugaccu

SEQ ID NO: 1948 - RNA, 19 nt, artificial
  Oligomer
ucuucagcauuuuguacca

SEQ ID NO: 1949 - RNA, 19 nt, artificial
  Oligomer
cucagggucagcaucauca

SEQ ID NO: 1950 - RNA, 19 nt, artificial
  Oligomer
aaguccuucagaagugcac

SEQ ID NO: 1951 - RNA, 19 nt, artificial
  Oligomer
gaggaauucuucuuuuccc

SEQ ID NO: 1952 - RNA, 19 nt, artificial
  Oligomer
ucuguagccaagcauggga

SEQ ID NO: 1953 - RNA, 19 nt, artificial
  Oligomer
gaaguuguacugacuccgg

SEQ ID NO: 1954 - RNA, 19 nt, artificial
  Oligomer
cacugguucauuuaacccu

SEQ ID NO: 1955 - RNA, 19 nt, artificial
  Oligomer
acugguucauuuaacccuc

SEQ ID NO: 1956 - RNA, 19 nt, artificial
  Oligomer
uuaacccucugucucggug

SEQ ID NO: 1957 - RNA, 19 nt, artificial
  Oligomer
guuccagaguucucugagg

SEQ ID NO: 1958 - RNA, 19 nt, artificial
  Oligomer
augguguucacuccaauca

SEQ ID NO: 1959 - RNA, 19 nt, artificial
  Oligomer
uaccucaggagcuuaccaa

SEQ ID NO: 1960 - RNA, 19 nt, artificial
  Oligomer
aucagaccaugcacuaugg

SEQ ID NO: 1961 - RNA, 19 nt, artificial
  Oligomer
cugugauucuucagagccc

SEQ ID NO: 1962 - RNA, 19 nt, artificial
  Oligomer
auucuucagagcccaggag

SEQ ID NO: 1963 - RNA, 19 nt, artificial
  Oligomer
cugguucauuuaacccucu

SEQ ID NO: 1964 - RNA, 19 nt, artificial
  Oligomer
cagcuucauaaacaucuuc

SEQ ID NO: 1965 - RNA, 19 nt, artificial
  Oligomer
aggaggaauucuucuuuuc

SEQ ID NO: 1966 - RNA, 19 nt, artificial
  Oligomer
aaacucucgaagacgauca

SEQ ID NO: 1967 - RNA, 19 nt, artificial
  Oligomer
auguggaacugucaagcag

SEQ ID NO: 1968 - RNA, 19 nt, artificial
  Oligomer
aaaagauggcagcagcuca

SEQ ID NO: 1969 - RNA, 19 nt, artificial
  Oligomer
accucuagccuuuuggugg

SEQ ID NO: 1970 - RNA, 19 nt, artificial
  Oligomer
cucauacucuuggugaucu

SEQ ID NO: 1971 - RNA, 19 nt, artificial
  Oligomer
aacucucgaagacgaucag

SEQ ID NO: 1972 - RNA, 19 nt, artificial
  Oligomer
ucgaagacgaucagaaggg

SEQ ID NO: 1973 - RNA, 19 nt, artificial
  Oligomer
uucaugguguucacuccaa

SEQ ID NO: 1974 - RNA, 19 nt, artificial
  Oligomer
uuagcagucucacacggac

SEQ ID NO: 1975 - RNA, 19 nt, artificial
  Oligomer
acaucugcgaugaaguugu

SEQ ID NO: 1976 - RNA, 19 nt, artificial
  Oligomer
cugcgaugaaguuguacug

SEQ ID NO: 1977 - RNA, 19 nt, artificial
  Oligomer
uuuucacccuccuucagag

SEQ ID NO: 1978 - RNA, 19 nt, artificial
  Oligomer
uaucuguagccaagcaugg

SEQ ID NO: 1979 - RNA, 19 nt, artificial
  Oligomer
aagcaugggaaucuuugcu

SEQ ID NO: 1980 - RNA, 19 nt, artificial
  Oligomer
uuucuuuaauaggagguca

SEQ ID NO: 1981 - RNA, 19 nt, artificial
  Oligomer
guuucugugauucuucaga

SEQ ID NO: 1982 - RNA, 19 nt, artificial
  Oligomer
ucagccagaaaggcaagga

SEQ ID NO: 1983 - RNA, 19 nt, artificial
  Oligomer
uggugaucuauucauucug

SEQ ID NO: 1984 - RNA, 19 nt, artificial
  Oligomer
agaaguuccugacgucagc

SEQ ID NO: 1985 - RNA, 19 nt, artificial
  Oligomer
cuucauaaacaucuucagc

SEQ ID NO: 1986 - RNA, 19 nt, artificial
  Oligomer
cagcaguuauggagcuucc

SEQ ID NO: 1987 - RNA, 19 nt, artificial
  Oligomer
aggaucucgauauagacca

SEQ ID NO: 1988 - RNA, 19 nt, artificial
  Oligomer
cugucaagcagaaguuuuc

SEQ ID NO: 1989 - RNA, 19 nt, artificial
  Oligomer
aucuguagccaagcauggg

SEQ ID NO: 1990 - RNA, 19 nt, artificial
  Oligomer
ucugugauucuucagagcc

SEQ ID NO: 1991 - RNA, 19 nt, artificial
  Oligomer
acggguuccagaguucucu

SEQ ID NO: 1992 - RNA, 19 nt, artificial
  Oligomer
ugaaguccuucagaagugc

SEQ ID NO: 1993 - RNA, 19 nt, artificial
  Oligomer
uuucacccuccuucagagg

SEQ ID NO: 1994 - RNA, 19 nt, artificial
  Oligomer
auggcagcagcucauuuuc

SEQ ID NO: 1995 - RNA, 19 nt, artificial
  Oligomer
cauuuucuuuaauaggagg

SEQ ID NO: 1996 - RNA, 19 nt, artificial
  Oligomer
ugugauucuucagagccca

SEQ ID NO: 1997 - RNA, 19 nt, artificial
  Oligomer
ugguucauuuaacccucug

SEQ ID NO: 1998 - RNA, 19 nt, artificial
  Oligomer
auuccggaggaggaauucu

SEQ ID NO: 1999 - RNA, 19 nt, artificial
  Oligomer
uuccggaggaggaauucuu

SEQ ID NO: 2000 - RNA, 19 nt, artificial
  Oligomer
auggcaaaggagauuccag

SEQ ID NO: 2001 - RNA, 19 nt, artificial
  Oligomer
ccaugcacuauggaugugg

SEQ ID NO: 2002 - RNA, 19 nt, artificial
  Oligomer
caagcaugggaaucuuugc

SEQ ID NO: 2003 - RNA, 19 nt, artificial
  Oligomer
agcaugggaaucuuugcuc

SEQ ID NO: 2004 - RNA, 19 nt, artificial
  Oligomer
acugcccacaaaagauggc

SEQ ID NO: 2005 - RNA, 19 nt, artificial
  Oligomer
uucuuuaauaggaggucag

SEQ ID NO: 2006 - RNA, 19 nt, artificial
  Oligomer
gugaucuauucauucugug

SEQ ID NO: 2007 - RNA, 19 nt, artificial
  Oligomer
ucauucugugaccucaggg

SEQ ID NO: 2008 - RNA, 19 nt, artificial
  Oligomer
acgaucagaagggauggca

SEQ ID NO: 2009 - RNA, 19 nt, artificial
  Oligomer
gcugucaguaucuguagcc

SEQ ID NO: 2010 - RNA, 19 nt, artificial
  Oligomer
cugucaguaucuguagcca

SEQ ID NO: 2011 - RNA, 19 nt, artificial
  Oligomer
gcaugggaaucuuugcucc

SEQ ID NO: 2012 - RNA, 19 nt, artificial
  Oligomer
auggucagcuccaguaucu

SEQ ID NO: 2013 - RNA, 19 nt, artificial
  Oligomer
aagcagcaguuauggagcu

SEQ ID NO: 2014 - RNA, 19 nt, artificial
  Oligomer
cuuagucugaauccucagc

SEQ ID NO: 2015 - RNA, 19 nt, artificial
  Oligomer
cacuauggauguggaacug

SEQ ID NO: 2016 - RNA, 19 nt, artificial
  Oligomer
uauggauguggaacuguca

SEQ ID NO: 2017 - RNA, 19 nt, artificial
  Oligomer
augggaaucuuugcuccca

SEQ ID NO: 2018 - RNA, 19 nt, artificial
  Oligomer
cugcccacaaaagauggca

SEQ ID NO: 2019 - RNA, 19 nt, artificial
  Oligomer
aaagauggcagcagcucau

SEQ ID NO: 2020 - RNA, 19 nt, artificial
  Oligomer
auacagcuuuaccucuagc

SEQ ID NO: 2021 - RNA, 19 nt, artificial
  Oligomer
uaccucuagccuuuuggug

SEQ ID NO: 2022 - RNA, 19 nt, artificial
  Oligomer
cugaaguccuucagaagug

SEQ ID NO: 2023 - RNA, 19 nt, artificial
  Oligomer
aagacgaucagaagggaug

SEQ ID NO: 2024 - RNA, 19 nt, artificial
  Oligomer
agacgaucagaagggaugg

SEQ ID NO: 2025 - RNA, 19 nt, artificial
  Oligomer
ggauggcaaaggagauucc

SEQ ID NO: 2026 - RNA, 19 nt, artificial
  Oligomer
ugaccuucaugguguucac

SEQ ID NO: 2027 - RNA, 19 nt, artificial
  Oligomer
guuggugacaaugagccca

SEQ ID NO: 2028 - RNA, 19 nt, artificial
  Oligomer
uagccaagcaugggaaucu

SEQ ID NO: 2029 - RNA, 19 nt, artificial
  Oligomer
ugcccacaaaagauggcag

SEQ ID NO: 2030 - RNA, 19 nt, artificial
  Oligomer
uuaccucuagccuuuuggu

SEQ ID NO: 2031 - RNA, 19 nt, artificial
  Oligomer
aaccucagccagaaaggca

SEQ ID NO: 2032 - RNA, 19 nt, artificial
  Oligomer
gcaaggaggaaaucagagc

SEQ ID NO: 2033 - RNA, 19 nt, artificial
  Oligomer
uuggugacaaugagcccau

SEQ ID NO: 2034 - RNA, 19 nt, artificial
  Oligomer
uccaccacaucugcgauga

SEQ ID NO: 2035 - RNA, 19 nt, artificial
  Oligomer
cuauggauguggaacuguc

SEQ ID NO: 2036 - RNA, 19 nt, artificial
  Oligomer
agcugucaguaucuguagc

SEQ ID NO: 2037 - RNA, 19 nt, artificial
  Oligomer
agcagcaccugacuaacug

SEQ ID NO: 2038 - RNA, 19 nt, artificial
  Oligomer
aaaucagagcaggagccuc

SEQ ID NO: 2039 - RNA, 19 nt, artificial
  Oligomer
caaaggagauuccagcugu

SEQ ID NO: 2040 - RNA, 19 nt, artificial
  Oligomer
aaaggagauuccagcugug

SEQ ID NO: 2041 - RNA, 19 nt, artificial
  Oligomer
caugggaaucuuugcuccc

SEQ ID NO: 2042 - RNA, 19 nt, artificial
  Oligomer
auaggaggucaggaugguc

SEQ ID NO: 2043 - RNA, 19 nt, artificial
  Oligomer
acgaugcagaaacucucga

SEQ ID NO: 2044 - RNA, 19 nt, artificial
  Oligomer
ccuucaugguguucacucc

SEQ ID NO: 2045 - RNA, 19 nt, artificial
  Oligomer
uucauucugugaccucagg

SEQ ID NO: 2046 - RNA, 19 nt, artificial
  Oligomer
aaggagauuccagcuguga

SEQ ID NO: 2047 - RNA, 19 nt, artificial
  Oligomer
uggcaaaggagauuccagc

SEQ ID NO: 2048 - RNA, 19 nt, artificial
  Oligomer
ucugaauccucagcguugc

SEQ ID NO: 2049 - RNA, 19 nt, artificial
  Oligomer
auucauucugugaccucag

SEQ ID NO: 2050 - RNA, 19 nt, artificial
  Oligomer
accaugcacuauggaugug

SEQ ID NO: 2051 - RNA, 19 nt, artificial
  Oligomer
uuuccaaaaucaauagcug

SEQ ID NO: 2052 - RNA, 19 nt, artificial
  Oligomer
aguuuccaaaaucaauagc

SEQ ID NO: 2053 - RNA, 19 nt, artificial
  Oligomer
guuuccaaaaucaauagcu

SEQ ID NO: 2054 - RNA, 21 nt, artificial
  Oligomer
cgagaaacacugaccuuauau

SEQ ID NO: 2055 - RNA, 21 nt, artificial
  Oligomer
gaagaaucacagaaacacuuu

SEQ ID NO: 2056 - RNA, 21 nt, artificial
  Oligomer
ugaauagaucaccaagaguau

SEQ ID NO: 2057 - RNA, 21 nt, artificial
  Oligomer
gacgagaaacacugaccuuau

SEQ ID NO: 2058 - RNA, 21 nt, artificial
  Oligomer
cgagacagaggguuaaaugaa

SEQ ID NO: 2059 - RNA, 21 nt, artificial
  Oligomer
acgagaaacacugaccuuaua

SEQ ID NO: 2060 - RNA, 21 nt, artificial
  Oligomer
gggugaaaacuucugcuugac

SEQ ID NO: 2061 - RNA, 21 nt, artificial
  Oligomer
ggagggugaaaacuucugcuu

SEQ ID NO: 2062 - RNA, 21 nt, artificial
  Oligomer
agaaacacugaccuuauaugu

SEQ ID NO: 2063 - RNA, 21 nt, artificial
  Oligomer
ugaagaaucacagaaacacuu

SEQ ID NO: 2064 - RNA, 21 nt, artificial
  Oligomer
accgagacagaggguuaaaug

SEQ ID NO: 2065 - RNA, 21 nt, artificial
  Oligomer
uggugaugugauuuuggccau

SEQ ID NO: 2066 - RNA, 21 nt, artificial
  Oligomer
ggugaaaacuucugcuugaca

SEQ ID NO: 2067 - RNA, 21 nt, artificial
  Oligomer
ccgagacagaggguuaaauga

SEQ ID NO: 2068 - RNA, 21 nt, artificial
  Oligomer
cggccuggugaugugauuuug

SEQ ID NO: 2069 - RNA, 21 nt, artificial
  Oligomer
gccguggucuauaucgagauc

SEQ ID NO: 2070 - RNA, 21 nt, artificial
  Oligomer
ugacauggguuucuugguaag

SEQ ID NO: 2071 - RNA, 21 nt, artificial
  Oligomer
gcggccuggugaugugauuuu

SEQ ID NO: 2072 - RNA, 21 nt, artificial
  Oligomer
gcagaugugguggagaagaca

SEQ ID NO: 2073 - RNA, 21 nt, artificial
  Oligomer
ccaucuuuugugggcaguuag

SEQ ID NO: 2074 - RNA, 21 nt, artificial
  Oligomer
ccauccugaccuccuauuaaa

SEQ ID NO: 2075 - RNA, 21 nt, artificial
  Oligomer
augaagcuguucgaacccaau

SEQ ID NO: 2076 - RNA, 21 nt, artificial
  Oligomer
ggccuggugaugugauuuugg

SEQ ID NO: 2077 - RNA, 21 nt, artificial
  Oligomer
ugcggccuggugaugugauuu

SEQ ID NO: 2078 - RNA, 21 nt, artificial
  Oligomer
gggaggugauuggagugaaca

SEQ ID NO: 2079 - RNA, 21 nt, artificial
  Oligomer
ugccguggucuauaucgagau

SEQ ID NO: 2080 - RNA, 21 nt, artificial
  Oligomer
ccuauuaaagaaaaugagcug

SEQ ID NO: 2081 - RNA, 21 nt, artificial
  Oligomer
uccuuugccaucccuucugau

SEQ ID NO: 2082 - RNA, 21 nt, artificial
  Oligomer
gagggugaaaacuucugcuug

SEQ ID NO: 2083 - RNA, 21 nt, artificial
  Oligomer
uccugcucugauuuccuccuu

SEQ ID NO: 2084 - RNA, 21 nt, artificial
  Oligomer
ggaggugauuggagugaacac

SEQ ID NO: 2085 - RNA, 21 nt, artificial
  Oligomer
gucuauaucgagauccuggac

SEQ ID NO: 2086 - RNA, 21 nt, artificial
  Oligomer
ccuuucuggcugagguucuga

SEQ ID NO: 2087 - RNA, 21 nt, artificial
  Oligomer
ucugauuuccuccuugccuuu

SEQ ID NO: 2088 - RNA, 21 nt, artificial
  Oligomer
cucugauuuccuccuugccuu

SEQ ID NO: 2089 - RNA, 21 nt, artificial
  Oligomer
ccugcucugauuuccuccuug

SEQ ID NO: 2090 - RNA, 21 nt, artificial
  Oligomer
cagaugguacaaaaugcugaa

SEQ ID NO: 2091 - RNA, 21 nt, artificial
  Oligomer
ggugaugugauuuuggccauu

SEQ ID NO: 2092 - RNA, 21 nt, artificial
  Oligomer
cgucuucgagaguuucugcau

SEQ ID NO: 2093 - RNA, 21 nt, artificial
  Oligomer
cauggucugaugagugcgguu

SEQ ID NO: 2094 - RNA, 21 nt, artificial
  Oligomer
auguuuaugaagcuguucgaa

SEQ ID NO: 2095 - RNA, 21 nt, artificial
  Oligomer
gauguuuaugaagcuguucga

SEQ ID NO: 2096 - RNA, 21 nt, artificial
  Oligomer
accauccugaccuccuauuaa

SEQ ID NO: 2097 - RNA, 21 nt, artificial
  Oligomer
gcaccgagacagaggguuaaa

SEQ ID NO: 2098 - RNA, 21 nt, artificial
  Oligomer
cugacauggguuucuugguaa

SEQ ID NO: 2099 - RNA, 21 nt, artificial
  Oligomer
agaugguacaaaaugcugaag

SEQ ID NO: 2100 - RNA, 21 nt, artificial
  Oligomer
gcagaugguacaaaaugcuga

SEQ ID NO: 2101 - RNA, 21 nt, artificial
  Oligomer
gggagcagaugguacaaaaug

SEQ ID NO: 2102 - RNA, 21 nt, artificial
  Oligomer
gggacgagaaacacugaccuu

SEQ ID NO: 2103 - RNA, 21 nt, artificial
  Oligomer
gugaugugauuuuggccauug

SEQ ID NO: 2104 - RNA, 21 nt, artificial
  Oligomer
ggcagugcuguuguuguugug

SEQ ID NO: 2105 - RNA, 21 nt, artificial
  Oligomer
gaggucacagaaugaauagau

SEQ ID NO: 2106 - RNA, 21 nt, artificial
  Oligomer
ugaugugauuuuggccauugg

SEQ ID NO: 2107 - RNA, 21 nt, artificial
  Oligomer
ugaaggucacagcuggaaucu

SEQ ID NO: 2108 - RNA, 21 nt, artificial
  Oligomer
gguugcugacauggguuucuu

SEQ ID NO: 2109 - RNA, 21 nt, artificial
  Oligomer
caguacaacuucaucgcagau

SEQ ID NO: 2110 - RNA, 21 nt, artificial
  Oligomer
ccggagucaguacaacuucau

SEQ ID NO: 2111 - RNA, 21 nt, artificial
  Oligomer
acagaaugaauagaucaccaa

SEQ ID NO: 2112 - RNA, 21 nt, artificial
  Oligomer
gagaccacaauucccggcauu

SEQ ID NO: 2113 - RNA, 21 nt, artificial
  Oligomer
gcugacauggguuucuuggua

SEQ ID NO: 2114 - RNA, 21 nt, artificial
  Oligomer
ucaguacaacuucaucgcaga

SEQ ID NO: 2115 - RNA, 21 nt, artificial
  Oligomer
gaagauguuuaugaagcuguu

SEQ ID NO: 2116 - RNA, 21 nt, artificial
  Oligomer
gaaucuccuuugccaucccuu

SEQ ID NO: 2117 - RNA, 21 nt, artificial
  Oligomer
ggcucugaagaaucacagaaa

SEQ ID NO: 2118 - RNA, 21 nt, artificial
  Oligomer
ggacgagaaacacugaccuua

SEQ ID NO: 2119 - RNA, 21 nt, artificial
  Oligomer
gugaugaugcugacccugagu

SEQ ID NO: 2120 - RNA, 21 nt, artificial
  Oligomer
gcuuggcuacagauacugaca

SEQ ID NO: 2121 - RNA, 21 nt, artificial
  Oligomer
guacaaaaugcugaagauguu

SEQ ID NO: 2122 - RNA, 21 nt, artificial
  Oligomer
ggaaaagaagaauuccuccuc

SEQ ID NO: 2123 - RNA, 21 nt, artificial
  Oligomer
cuccuuugccaucccuucuga

SEQ ID NO: 2124 - RNA, 21 nt, artificial
  Oligomer
agaccacaauucccggcauuc

SEQ ID NO: 2125 - RNA, 21 nt, artificial
  Oligomer
gcuugacaguuccacauccau

SEQ ID NO: 2126 - RNA, 21 nt, artificial
  Oligomer
ugacuccugggcucugaagaa

SEQ ID NO: 2127 - RNA, 21 nt, artificial
  Oligomer
gcagugcuguuguuguugugg

SEQ ID NO: 2128 - RNA, 21 nt, artificial
  Oligomer
aggucacagaaugaauagauc

SEQ ID NO: 2129 - RNA, 21 nt, artificial
  Oligomer
gcugaagauguuuaugaagcu

SEQ ID NO: 2130 - RNA, 21 nt, artificial
  Oligomer
cgguugcugacauggguuucu

SEQ ID NO: 2131 - RNA, 21 nt, artificial
  Oligomer
ugcuugacaguuccacaucca

SEQ ID NO: 2132 - RNA, 21 nt, artificial
  Oligomer
gggcagugcuguuguuguugu

SEQ ID NO: 2133 - RNA, 21 nt, artificial
  Oligomer
gaaugaauagaucaccaagag

SEQ ID NO: 2134 - RNA, 21 nt, artificial
  Oligomer
cagaaugaauagaucaccaag

SEQ ID NO: 2135 - RNA, 21 nt, artificial
  Oligomer
augguacaaaaugcugaagau

SEQ ID NO: 2136 - RNA, 21 nt, artificial
  Oligomer
gaagaauuccuccuccggaau

SEQ ID NO: 2137 - RNA, 21 nt, artificial
  Oligomer
gauuggagugaacaccaugaa

SEQ ID NO: 2138 - RNA, 21 nt, artificial
  Oligomer
ccauaacugcugcuucaggag

SEQ ID NO: 2139 - RNA, 21 nt, artificial
  Oligomer
ggagcaaagauucccaugcuu

SEQ ID NO: 2140 - RNA, 21 nt, artificial
  Oligomer
cugaagaaucacagaaacacu

SEQ ID NO: 2141 - RNA, 21 nt, artificial
  Oligomer
cucugaagaaucacagaaaca

SEQ ID NO: 2142 - RNA, 21 nt, artificial
  Oligomer
ugauuuccuccuugccuuucu

SEQ ID NO: 2143 - RNA, 21 nt, artificial
  Oligomer
ugguacaaaaugcugaagaug

SEQ ID NO: 2144 - RNA, 21 nt, artificial
  Oligomer
gugauuggagugaacaccaug

SEQ ID NO: 2145 - RNA, 21 nt, artificial
  Oligomer
cucuuaccggugcgagucaaa

SEQ ID NO: 2146 - RNA, 21 nt, artificial
  Oligomer
agaguccgugugagacugcua

SEQ ID NO: 2147 - RNA, 21 nt, artificial
  Oligomer
gguuucuugguaagcuccuga

SEQ ID NO: 2148 - RNA, 21 nt, artificial
  Oligomer
ccaccaaaaggcuagagguaa

SEQ ID NO: 2149 - RNA, 21 nt, artificial
  Oligomer
gcucugaagaaucacagaaac

SEQ ID NO: 2150 - RNA, 21 nt, artificial
  Oligomer
cggagucaguacaacuucauc

SEQ ID NO: 2151 - RNA, 21 nt, artificial
  Oligomer
agaggguuaaaugaaccagug

SEQ ID NO: 2152 - RNA, 21 nt, artificial
  Oligomer
ugaagauguuuaugaagcugu

SEQ ID NO: 2153 - RNA, 21 nt, artificial
  Oligomer
gcgugcacuucugaaggacuu

SEQ ID NO: 2154 - RNA, 21 nt, artificial
  Oligomer
agacaucgcaacgcugaggau

SEQ ID NO: 2155 - RNA, 21 nt, artificial
  Oligomer
cuugguaagcuccugagguaa

SEQ ID NO: 2156 - RNA, 21 nt, artificial
  Oligomer
ggguuucuugguaagcuccug

SEQ ID NO: 2157 - RNA, 21 nt, artificial
  Oligomer
guacaacuucaucgcagaugu

SEQ ID NO: 2158 - RNA, 21 nt, artificial
  Oligomer
gggcucugaagaaucacagaa

SEQ ID NO: 2159 - RNA, 21 nt, artificial
  Oligomer
cccggagucaguacaacuuca

SEQ ID NO: 2160 - RNA, 21 nt, artificial
  Oligomer
cagagaacucuggaacccguu

SEQ ID NO: 2161 - RNA, 21 nt, artificial
  Oligomer
cugaagauguuuaugaagcug

SEQ ID NO: 2162 - RNA, 21 nt, artificial
  Oligomer
ccaugaaggucacagcuggaa

SEQ ID NO: 2163 - RNA, 21 nt, artificial
  Oligomer
aacgcugaggauucagacuaa

SEQ ID NO: 2164 - RNA, 21 nt, artificial
  Oligomer
cgaugggcucauugucaccaa

SEQ ID NO: 2165 - RNA, 21 nt, artificial
  Oligomer
guggucuauaucgagauccug

SEQ ID NO: 2166 - RNA, 21 nt, artificial
  Oligomer
gaaaacuucugcuugacaguu

SEQ ID NO: 2167 - RNA, 21 nt, artificial
  Oligomer
ucccaugcuuggcuacagaua

SEQ ID NO: 2168 - RNA, 21 nt, artificial
  Oligomer
aggcuagagguaaagcuguau

SEQ ID NO: 2169 - RNA, 21 nt, artificial
  Oligomer
caccgagacagaggguuaaau

SEQ ID NO: 2170 - RNA, 21 nt, artificial
  Oligomer
caagaguaugaggcuccugcu

SEQ ID NO: 2171 - RNA, 21 nt, artificial
  Oligomer
agaagaauuccuccuccggaa

SEQ ID NO: 2172 - RNA, 21 nt, artificial
  Oligomer
gggaaaagaagaauuccuccu

SEQ ID NO: 2173 - RNA, 21 nt, artificial
  Oligomer
acgcugaggauucagacuaag

SEQ ID NO: 2174 - RNA, 21 nt, artificial
  Oligomer
caacgcugaggauucagacua

SEQ ID NO: 2175 - RNA, 21 nt, artificial
  Oligomer
agcaccugccguggucuauau

SEQ ID NO: 2176 - RNA, 21 nt, artificial
  Oligomer
ccauagugcauggucugauga

SEQ ID NO: 2177 - RNA, 21 nt, artificial
  Oligomer
ugaaaacuucugcuugacagu

SEQ ID NO: 2178 - RNA, 21 nt, artificial
  Oligomer
gccucugaaggagggugaaaa

SEQ ID NO: 2179 - RNA, 21 nt, artificial
  Oligomer
ccugaccuccuauuaaagaaa

SEQ ID NO: 2180 - RNA, 21 nt, artificial
  Oligomer
cugaccauccugaccuccuau

SEQ ID NO: 2181 - RNA, 21 nt, artificial
  Oligomer
cuugccuuucuggcugagguu

SEQ ID NO: 2182 - RNA, 21 nt, artificial
  Oligomer
accaagaguaugaggcuccug

SEQ ID NO: 2183 - RNA, 21 nt, artificial
  Oligomer
caugaaggucacagcuggaau

SEQ ID NO: 2184 - RNA, 21 nt, artificial
  Oligomer
accaugaaggucacagcugga

SEQ ID NO: 2185 - RNA, 21 nt, artificial
  Oligomer
cguggucuauaucgagauccu

SEQ ID NO: 2186 - RNA, 21 nt, artificial
  Oligomer
caguuccacauccauagugca

SEQ ID NO: 2187 - RNA, 21 nt, artificial
  Oligomer
ccucugaaggagggugaaaac

SEQ ID NO: 2188 - RNA, 21 nt, artificial
  Oligomer
gacagaggguuaaaugaacca

SEQ ID NO: 2189 - RNA, 21 nt, artificial
  Oligomer
augaggcuccugcucugauuu

SEQ ID NO: 2190 - RNA, 21 nt, artificial
  Oligomer
caccaagaguaugaggcuccu

SEQ ID NO: 2191 - RNA, 21 nt, artificial
  Oligomer
ugcugacgucaggaacuucug

SEQ ID NO: 2192 - RNA, 21 nt, artificial
  Oligomer
cccuucugaucgucuucgaga

SEQ ID NO: 2193 - RNA, 21 nt, artificial
  Oligomer
ccaucccuucugaucgucuuc

SEQ ID NO: 2194 - RNA, 21 nt, artificial
  Oligomer
ggugauuggagugaacaccau

SEQ ID NO: 2195 - RNA, 21 nt, artificial
  Oligomer
ggaagcuccauaacugcugcu

SEQ ID NO: 2196 - RNA, 21 nt, artificial
  Oligomer
uacugacagcuggccucugaa

SEQ ID NO: 2197 - RNA, 21 nt, artificial
  Oligomer
agauacugacagcuggccucu

SEQ ID NO: 2198 - RNA, 21 nt, artificial
  Oligomer
gggagcaaagauucccaugcu

SEQ ID NO: 2199 - RNA, 21 nt, artificial
  Oligomer
guuagucaggugcugcucuuu

SEQ ID NO: 2200 - RNA, 21 nt, artificial
  Oligomer
gaaaaugagcugcugccaucu

SEQ ID NO: 2201 - RNA, 21 nt, artificial
  Oligomer
ccuccuauuaaagaaaaugag

SEQ ID NO: 2202 - RNA, 21 nt, artificial
  Oligomer
cugaccuccuauuaaagaaaa

SEQ ID NO: 2203 - RNA, 21 nt, artificial
  Oligomer
gaccauccugaccuccuauua

SEQ ID NO: 2204 - RNA, 21 nt, artificial
  Oligomer
cacagaaugaauagaucacca

SEQ ID NO: 2205 - RNA, 21 nt, artificial
  Oligomer
gaauuccuccuccggaaucag

SEQ ID NO: 2206 - RNA, 21 nt, artificial
  Oligomer
gccaucccuucugaucgucuu

SEQ ID NO: 2207 - RNA, 21 nt, artificial
  Oligomer
cuaucucgaacggcucaggau

SEQ ID NO: 2208 - RNA, 21 nt, artificial
  Oligomer
ugacaguuccacauccauagu

SEQ ID NO: 2209 - RNA, 21 nt, artificial
  Oligomer
ggcuacagauacugacagcug

SEQ ID NO: 2210 - RNA, 21 nt, artificial
  Oligomer
ccaugcuuggcuacagauacu

SEQ ID NO: 2211 - RNA, 21 nt, artificial
  Oligomer
gccaucuuuugugggcaguua

SEQ ID NO: 2212 - RNA, 21 nt, artificial
  Oligomer
ugccaucuuuugugggcaguu

SEQ ID NO: 2213 - RNA, 21 nt, artificial
  Oligomer
ggagauacuggagcugaccau

SEQ ID NO: 2214 - RNA, 21 nt, artificial
  Oligomer
caccaaaaggcuagagguaaa

SEQ ID NO: 2215 - RNA, 21 nt, artificial
  Oligomer
cccaccaaaaggcuagaggua

SEQ ID NO: 2216 - RNA, 21 nt, artificial
  Oligomer
ugggcucugaagaaucacaga

SEQ ID NO: 2217 - RNA, 21 nt, artificial
  Oligomer
ggucacagaaugaauagauca

SEQ ID NO: 2218 - RNA, 21 nt, artificial
  Oligomer
gaagcuccauaacugcugcuu

SEQ ID NO: 2219 - RNA, 21 nt, artificial
  Oligomer
ccguggucuauaucgagaucc

SEQ ID NO: 2220 - RNA, 21 nt, artificial
  Oligomer
uccauagugcauggucugaug

SEQ ID NO: 2221 - RNA, 21 nt, artificial
  Oligomer
ugaaggagggugaaaacuucu

SEQ ID NO: 2222 - RNA, 21 nt, artificial
  Oligomer
gagcaaagauucccaugcuug

SEQ ID NO: 2223 - RNA, 21 nt, artificial
  Oligomer
gaccuccuauuaaagaaaaug

SEQ ID NO: 2224 - RNA, 21 nt, artificial
  Oligomer
accaaaaggcuagagguaaag

SEQ ID NO: 2225 - RNA, 21 nt, artificial
  Oligomer
gcacuucugaaggacuucagg

SEQ ID NO: 2226 - RNA, 21 nt, artificial
  Oligomer
cugaucgucuucgagaguuuc

SEQ ID NO: 2227 - RNA, 21 nt, artificial
  Oligomer
ucugaucgucuucgagaguuu

SEQ ID NO: 2228 - RNA, 21 nt, artificial
  Oligomer
aggugauuggagugaacacca

SEQ ID NO: 2229 - RNA, 21 nt, artificial
  Oligomer
gcuccauaacugcugcuucag

SEQ ID NO: 2230 - RNA, 21 nt, artificial
  Oligomer
cccaugcuuggcuacagauac

SEQ ID NO: 2231 - RNA, 21 nt, artificial
  Oligomer
ccaaaaggcuagagguaaagc

SEQ ID NO: 2232 - RNA, 21 nt, artificial
  Oligomer
cccugaggucacagaaugaau

SEQ ID NO: 2233 - RNA, 21 nt, artificial
  Oligomer
ucccuucugaucgucuucgag

SEQ ID NO: 2234 - RNA, 21 nt, artificial
  Oligomer
cgugcacuucugaaggacuuc

SEQ ID NO: 2235 - RNA, 21 nt, artificial
  Oligomer
ccacauccauagugcaugguc

SEQ ID NO: 2236 - RNA, 21 nt, artificial
  Oligomer
acagauacugacagcuggccu

SEQ ID NO: 2237 - RNA, 21 nt, artificial
  Oligomer
uggcuacagauacugacagcu

SEQ ID NO: 2238 - RNA, 21 nt, artificial
  Oligomer
cugccaucuuuugugggcagu

SEQ ID NO: 2239 - RNA, 21 nt, artificial
  Oligomer
uccugaccuccuauuaaagaa

SEQ ID NO: 2240 - RNA, 21 nt, artificial
  Oligomer
ggcuagagguaaagcuguauc

SEQ ID NO: 2241 - RNA, 21 nt, artificial
  Oligomer
ugcacuucugaaggacuucag

SEQ ID NO: 2242 - RNA, 21 nt, artificial
  Oligomer
ugccaucccuucugaucgucu

SEQ ID NO: 2243 - RNA, 21 nt, artificial
  Oligomer
ccugggagcaaagauucccau

SEQ ID NO: 2244 - RNA, 21 nt, artificial
  Oligomer
ugaccauccugaccuccuauu

SEQ ID NO: 2245 - RNA, 21 nt, artificial
  Oligomer
gagcagaugguacaaaaugcu

SEQ ID NO: 2246 - RNA, 21 nt, artificial
  Oligomer
ucacagcuggaaucuccuuug

SEQ ID NO: 2247 - RNA, 21 nt, artificial
  Oligomer
uucccaugcuuggcuacagau

SEQ ID NO: 2248 - RNA, 21 nt, artificial
  Oligomer
aaagauucccaugcuuggcua

SEQ ID NO: 2249 - RNA, 21 nt, artificial
  Oligomer
ggagcagaugguacaaaaugc

SEQ ID NO: 2250 - RNA, 21 nt, artificial
  Oligomer
gugaacaccaugaaggucaca

SEQ ID NO: 2251 - RNA, 21 nt, artificial
  Oligomer
acauccauagugcauggucug

SEQ ID NO: 2252 - RNA, 21 nt, artificial
  Oligomer
ggaaucuccuuugccaucccu

SEQ ID NO: 2253 - RNA, 21 nt, artificial
  Oligomer
ggucacagcuggaaucuccuu

SEQ ID NO: 2254 - RNA, 21 nt, artificial
  Oligomer
ggagugaacaccaugaagguc

SEQ ID NO: 2255 - RNA, 21 nt, artificial
  Oligomer
uggagugaacaccaugaaggu

SEQ ID NO: 2256 - RNA, 21 nt, artificial
  Oligomer
ccugaggucacagaaugaaua

SEQ ID NO: 2257 - RNA, 21 nt, artificial
  Oligomer
cugaggucacagaaugaauag

SEQ ID NO: 2258 - RNA, 21 nt, artificial
  Oligomer
agcuggaaucuccuuugccau

SEQ ID NO: 2259 - RNA, 21 nt, artificial
  Oligomer
aggucacagcuggaaucuccu

SEQ ID NO: 2260 - RNA, 21 nt, artificial
  Oligomer
gcaacgcugaggauucagacu

SEQ ID NO: 2261 - RNA, 21 nt, artificial
  Oligomer
uccacauccauagugcauggu

SEQ ID NO: 2262 - RNA, 21 nt, artificial
  Oligomer
aggcuccugcucugauuuccu

SEQ ID NO: 2263 - RNA, 21 nt, artificial
  Oligomer
auauaaggucaguguuucucg

SEQ ID NO: 2264 - RNA, 21 nt, artificial
  Oligomer
aaaguguuucugugauucuuc

SEQ ID NO: 2265 - RNA, 21 nt, artificial
  Oligomer
auacucuuggugaucuauuca

SEQ ID NO: 2266 - RNA, 21 nt, artificial
  Oligomer
auaaggucaguguuucucguc

SEQ ID NO: 2267 - RNA, 21 nt, artificial
  Oligomer
uucauuuaacccucugucucg

SEQ ID NO: 2268 - RNA, 21 nt, artificial
  Oligomer
uauaaggucaguguuucucgu

SEQ ID NO: 2269 - RNA, 21 nt, artificial
  Oligomer
gucaagcagaaguuuucaccc

SEQ ID NO: 2270 - RNA, 21 nt, artificial
  Oligomer
aagcagaaguuuucacccucc

SEQ ID NO: 2271 - RNA, 21 nt, artificial
  Oligomer
acauauaaggucaguguuucu

SEQ ID NO: 2272 - RNA, 21 nt, artificial
  Oligomer
aaguguuucugugauucuuca

SEQ ID NO: 2273 - RNA, 21 nt, artificial
  Oligomer
cauuuaacccucugucucggu

SEQ ID NO: 2274 - RNA, 21 nt, artificial
  Oligomer
auggccaaaaucacaucacca

SEQ ID NO: 2275 - RNA, 21 nt, artificial
  Oligomer
ugucaagcagaaguuuucacc

SEQ ID NO: 2276 - RNA, 21 nt, artificial
  Oligomer
ucauuuaacccucugucucgg

SEQ ID NO: 2277 - RNA, 21 nt, artificial
  Oligomer
caaaaucacaucaccaggccg

SEQ ID NO: 2278 - RNA, 21 nt, artificial
  Oligomer
gaucucgauauagaccacggc

SEQ ID NO: 2279 - RNA, 21 nt, artificial
  Oligomer
cuuaccaagaaacccauguca

SEQ ID NO: 2280 - RNA, 21 nt, artificial
  Oligomer
aaaaucacaucaccaggccgc

SEQ ID NO: 2281 - RNA, 21 nt, artificial
  Oligomer
ugucuucuccaccacaucugc

SEQ ID NO: 2282 - RNA, 21 nt, artificial
  Oligomer
cuaacugcccacaaaagaugg

SEQ ID NO: 2283 - RNA, 21 nt, artificial
  Oligomer
uuuaauaggaggucaggaugg

SEQ ID NO: 2284 - RNA, 21 nt, artificial
  Oligomer
auuggguucgaacagcuucau

SEQ ID NO: 2285 - RNA, 21 nt, artificial
  Oligomer
ccaaaaucacaucaccaggcc

SEQ ID NO: 2286 - RNA, 21 nt, artificial
  Oligomer
aaaucacaucaccaggccgca

SEQ ID NO: 2287 - RNA, 21 nt, artificial
  Oligomer
uguucacuccaaucaccuccc

SEQ ID NO: 2288 - RNA, 21 nt, artificial
  Oligomer
aucucgauauagaccacggca

SEQ ID NO: 2289 - RNA, 21 nt, artificial
  Oligomer
cagcucauuuucuuuaauagg

SEQ ID NO: 2290 - RNA, 21 nt, artificial
  Oligomer
aucagaagggauggcaaagga

SEQ ID NO: 2291 - RNA, 21 nt, artificial
  Oligomer
caagcagaaguuuucacccuc

SEQ ID NO: 2292 - RNA, 21 nt, artificial
  Oligomer
aaggaggaaaucagagcagga

SEQ ID NO: 2293 - RNA, 21 nt, artificial
  Oligomer
guguucacuccaaucaccucc

SEQ ID NO: 2294 - RNA, 21 nt, artificial
  Oligomer
guccaggaucucgauauagac

SEQ ID NO: 2295 - RNA, 21 nt, artificial
  Oligomer
ucagaaccucagccagaaagg

SEQ ID NO: 2296 - RNA, 21 nt, artificial
  Oligomer
aaaggcaaggaggaaaucaga

SEQ ID NO: 2297 - RNA, 21 nt, artificial
  Oligomer
aaggcaaggaggaaaucagag

SEQ ID NO: 2298 - RNA, 21 nt, artificial
  Oligomer
caaggaggaaaucagagcagg

SEQ ID NO: 2299 - RNA, 21 nt, artificial
  Oligomer
uucagcauuuuguaccaucug

SEQ ID NO: 2300 - RNA, 21 nt, artificial
  Oligomer
aauggccaaaaucacaucacc

SEQ ID NO: 2301 - RNA, 21 nt, artificial
  Oligomer
augcagaaacucucgaagacg

SEQ ID NO: 2302 - RNA, 21 nt, artificial
  Oligomer
aaccgcacucaucagaccaug

SEQ ID NO: 2303 - RNA, 21 nt, artificial
  Oligomer
uucgaacagcuucauaaacau

SEQ ID NO: 2304 - RNA, 21 nt, artificial
  Oligomer
ucgaacagcuucauaaacauc

SEQ ID NO: 2305 - RNA, 21 nt, artificial
  Oligomer
uuaauaggaggucaggauggu

SEQ ID NO: 2306 - RNA, 21 nt, artificial
  Oligomer
uuuaacccucugucucggugc

SEQ ID NO: 2307 - RNA, 21 nt, artificial
  Oligomer
uuaccaagaaacccaugucag

SEQ ID NO: 2308 - RNA, 21 nt, artificial
  Oligomer
cuucagcauuuuguaccaucu

SEQ ID NO: 2309 - RNA, 21 nt, artificial
  Oligomer
ucagcauuuuguaccaucugc

SEQ ID NO: 2310 - RNA, 21 nt, artificial
  Oligomer
cauuuuguaccaucugcuccc

SEQ ID NO: 2311 - RNA, 21 nt, artificial
  Oligomer
aaggucaguguuucucguccc

SEQ ID NO: 2312 - RNA, 21 nt, artificial
  Oligomer
caauggccaaaaucacaucac

SEQ ID NO: 2313 - RNA, 21 nt, artificial
  Oligomer
cacaacaacaacagcacugcc

SEQ ID NO: 2314 - RNA, 21 nt, artificial
  Oligomer
aucuauucauucugugaccuc

SEQ ID NO: 2315 - RNA, 21 nt, artificial
  Oligomer
ccaauggccaaaaucacauca

SEQ ID NO: 2316 - RNA, 21 nt, artificial
  Oligomer
agauuccagcugugaccuuca

SEQ ID NO: 2317 - RNA, 21 nt, artificial
  Oligomer
aagaaacccaugucagcaacc

SEQ ID NO: 2318 - RNA, 21 nt, artificial
  Oligomer
aucugcgaugaaguuguacug

SEQ ID NO: 2319 - RNA, 21 nt, artificial
  Oligomer
augaaguuguacugacuccgg

SEQ ID NO: 2320 - RNA, 21 nt, artificial
  Oligomer
uuggugaucuauucauucugu

SEQ ID NO: 2321 - RNA, 21 nt, artificial
  Oligomer
aaugccgggaauuguggucuc

SEQ ID NO: 2322 - RNA, 21 nt, artificial
  Oligomer
uaccaagaaacccaugucagc

SEQ ID NO: 2323 - RNA, 21 nt, artificial
  Oligomer
ucugcgaugaaguuguacuga

SEQ ID NO: 2324 - RNA, 21 nt, artificial
  Oligomer
aacagcuucauaaacaucuuc

SEQ ID NO: 2325 - RNA, 21 nt, artificial
  Oligomer
aagggauggcaaaggagauuc

SEQ ID NO: 2326 - RNA, 21 nt, artificial
  Oligomer
uuucugugauucuucagagcc

SEQ ID NO: 2327 - RNA, 21 nt, artificial
  Oligomer
uaaggucaguguuucucgucc

SEQ ID NO: 2328 - RNA, 21 nt, artificial
  Oligomer
acucagggucagcaucaucac

SEQ ID NO: 2329 - RNA, 21 nt, artificial
  Oligomer
ugucaguaucuguagccaagc

SEQ ID NO: 2330 - RNA, 21 nt, artificial
  Oligomer
aacaucuucagcauuuuguac

SEQ ID NO: 2331 - RNA, 21 nt, artificial
  Oligomer
gaggaggaauucuucuuuucc

SEQ ID NO: 2332 - RNA, 21 nt, artificial
  Oligomer
ucagaagggauggcaaaggag

SEQ ID NO: 2333 - RNA, 21 nt, artificial
  Oligomer
gaaugccgggaauuguggucu

SEQ ID NO: 2334 - RNA, 21 nt, artificial
  Oligomer
auggauguggaacugucaagc

SEQ ID NO: 2335 - RNA, 21 nt, artificial
  Oligomer
uucuucagagcccaggaguca

SEQ ID NO: 2336 - RNA, 21 nt, artificial
  Oligomer
ccacaacaacaacagcacugc

SEQ ID NO: 2337 - RNA, 21 nt, artificial
  Oligomer
gaucuauucauucugugaccu

SEQ ID NO: 2338 - RNA, 21 nt, artificial
  Oligomer
agcuucauaaacaucuucagc

SEQ ID NO: 2339 - RNA, 21 nt, artificial
  Oligomer
agaaacccaugucagcaaccg

SEQ ID NO: 2340 - RNA, 21 nt, artificial
  Oligomer
uggauguggaacugucaagca

SEQ ID NO: 2341 - RNA, 21 nt, artificial
  Oligomer
acaacaacaacagcacugccc

SEQ ID NO: 2342 - RNA, 21 nt, artificial
  Oligomer
cucuuggugaucuauucauuc

SEQ ID NO: 2343 - RNA, 21 nt, artificial
  Oligomer
cuuggugaucuauucauucug

SEQ ID NO: 2344 - RNA, 21 nt, artificial
  Oligomer
aucuucagcauuuuguaccau

SEQ ID NO: 2345 - RNA, 21 nt, artificial
  Oligomer
auuccggaggaggaauucuuc

SEQ ID NO: 2346 - RNA, 21 nt, artificial
  Oligomer
uucaugguguucacuccaauc

SEQ ID NO: 2347 - RNA, 21 nt, artificial
  Oligomer
cuccugaagcagcaguuaugg

SEQ ID NO: 2348 - RNA, 21 nt, artificial
  Oligomer
aagcaugggaaucuuugcucc

SEQ ID NO: 2349 - RNA, 21 nt, artificial
  Oligomer
aguguuucugugauucuucag

SEQ ID NO: 2350 - RNA, 21 nt, artificial
  Oligomer
uguuucugugauucuucagag

SEQ ID NO: 2351 - RNA, 21 nt, artificial
  Oligomer
agaaaggcaaggaggaaauca

SEQ ID NO: 2352 - RNA, 21 nt, artificial
  Oligomer
caucuucagcauuuuguacca

SEQ ID NO: 2353 - RNA, 21 nt, artificial
  Oligomer
caugguguucacuccaaucac

SEQ ID NO: 2354 - RNA, 21 nt, artificial
  Oligomer
uuugacucgcaccgguaagag

SEQ ID NO: 2355 - RNA, 21 nt, artificial
  Oligomer
uagcagucucacacggacucu

SEQ ID NO: 2356 - RNA, 21 nt, artificial
  Oligomer
ucaggagcuuaccaagaaacc

SEQ ID NO: 2357 - RNA, 21 nt, artificial
  Oligomer
uuaccucuagccuuuuggugg

SEQ ID NO: 2358 - RNA, 21 nt, artificial
  Oligomer
guuucugugauucuucagagc

SEQ ID NO: 2359 - RNA, 21 nt, artificial
  Oligomer
gaugaaguuguacugacuccg

SEQ ID NO: 2360 - RNA, 21 nt, artificial
  Oligomer
cacugguucauuuaacccucu

SEQ ID NO: 2361 - RNA, 21 nt, artificial
  Oligomer
acagcuucauaaacaucuuca

SEQ ID NO: 2362 - RNA, 21 nt, artificial
  Oligomer
aaguccuucagaagugcacgc

SEQ ID NO: 2363 - RNA, 21 nt, artificial
  Oligomer
auccucagcguugcgaugucu

SEQ ID NO: 2364 - RNA, 21 nt, artificial
  Oligomer
uuaccucaggagcuuaccaag

SEQ ID NO: 2365 - RNA, 21 nt, artificial
  Oligomer
caggagcuuaccaagaaaccc

SEQ ID NO: 2366 - RNA, 21 nt, artificial
  Oligomer
acaucugcgaugaaguuguac

SEQ ID NO: 2367 - RNA, 21 nt, artificial
  Oligomer
uucugugauucuucagagccc

SEQ ID NO: 2368 - RNA, 21 nt, artificial
  Oligomer
ugaaguuguacugacuccggg

SEQ ID NO: 2369 - RNA, 21 nt, artificial
  Oligomer
aacggguuccagaguucucug

SEQ ID NO: 2370 - RNA, 21 nt, artificial
  Oligomer
cagcuucauaaacaucuucag

SEQ ID NO: 2371 - RNA, 21 nt, artificial
  Oligomer
uuccagcugugaccuucaugg

SEQ ID NO: 2372 - RNA, 21 nt, artificial
  Oligomer
uuagucugaauccucagcguu

SEQ ID NO: 2373 - RNA, 21 nt, artificial
  Oligomer
uuggugacaaugagcccaucg

SEQ ID NO: 2374 - RNA, 21 nt, artificial
  Oligomer
caggaucucgauauagaccac

SEQ ID NO: 2375 - RNA, 21 nt, artificial
  Oligomer
aacugucaagcagaaguuuuc

SEQ ID NO: 2376 - RNA, 21 nt, artificial
  Oligomer
uaucuguagccaagcauggga

SEQ ID NO: 2377 - RNA, 21 nt, artificial
  Oligomer
auacagcuuuaccucuagccu

SEQ ID NO: 2378 - RNA, 21 nt, artificial
  Oligomer
auuuaacccucugucucggug

SEQ ID NO: 2379 - RNA, 21 nt, artificial
  Oligomer
agcaggagccucauacucuug

SEQ ID NO: 2380 - RNA, 21 nt, artificial
  Oligomer
uuccggaggaggaauucuucu

SEQ ID NO: 2381 - RNA, 21 nt, artificial
  Oligomer
aggaggaauucuucuuuuccc

SEQ ID NO: 2382 - RNA, 21 nt, artificial
  Oligomer
cuuagucugaauccucagcgu

SEQ ID NO: 2383 - RNA, 21 nt, artificial
  Oligomer
uagucugaauccucagcguug

SEQ ID NO: 2384 - RNA, 21 nt, artificial
  Oligomer
auauagaccacggcaggugcu

SEQ ID NO: 2385 - RNA, 21 nt, artificial
  Oligomer
ucaucagaccaugcacuaugg

SEQ ID NO: 2386 - RNA, 21 nt, artificial
  Oligomer
acugucaagcagaaguuuuca

SEQ ID NO: 2387 - RNA, 21 nt, artificial
  Oligomer
uuuucacccuccuucagaggc

SEQ ID NO: 2388 - RNA, 21 nt, artificial
  Oligomer
uuucuuuaauaggaggucagg

SEQ ID NO: 2389 - RNA, 21 nt, artificial
  Oligomer
auaggaggucaggauggucag

SEQ ID NO: 2390 - RNA, 21 nt, artificial
  Oligomer
aaccucagccagaaaggcaag

SEQ ID NO: 2391 - RNA, 21 nt, artificial
  Oligomer
caggagccucauacucuuggu

SEQ ID NO: 2392 - RNA, 21 nt, artificial
  Oligomer
auuccagcugugaccuucaug

SEQ ID NO: 2393 - RNA, 21 nt, artificial
  Oligomer
uccagcugugaccuucauggu

SEQ ID NO: 2394 - RNA, 21 nt, artificial
  Oligomer
aggaucucgauauagaccacg

SEQ ID NO: 2395 - RNA, 21 nt, artificial
  Oligomer
ugcacuauggauguggaacug

SEQ ID NO: 2396 - RNA, 21 nt, artificial
  Oligomer
guuuucacccuccuucagagg

SEQ ID NO: 2397 - RNA, 21 nt, artificial
  Oligomer
ugguucauuuaacccucuguc

SEQ ID NO: 2398 - RNA, 21 nt, artificial
  Oligomer
aaaucagagcaggagccucau

SEQ ID NO: 2399 - RNA, 21 nt, artificial
  Oligomer
aggagccucauacucuuggug

SEQ ID NO: 2400 - RNA, 21 nt, artificial
  Oligomer
cagaaguuccugacgucagca

SEQ ID NO: 2401 - RNA, 21 nt, artificial
  Oligomer
ucucgaagacgaucagaaggg

SEQ ID NO: 2402 - RNA, 21 nt, artificial
  Oligomer
gaagacgaucagaagggaugg

SEQ ID NO: 2403 - RNA, 21 nt, artificial
  Oligomer
augguguucacuccaaucacc

SEQ ID NO: 2404 - RNA, 21 nt, artificial
  Oligomer
agcagcaguuauggagcuucc

SEQ ID NO: 2405 - RNA, 21 nt, artificial
  Oligomer
uucagaggccagcugucagua

SEQ ID NO: 2406 - RNA, 21 nt, artificial
  Oligomer
agaggccagcugucaguaucu

SEQ ID NO: 2407 - RNA, 21 nt, artificial
  Oligomer
agcaugggaaucuuugcuccc

SEQ ID NO: 2408 - RNA, 21 nt, artificial
  Oligomer
aaagagcagcaccugacuaac

SEQ ID NO: 2409 - RNA, 21 nt, artificial
  Oligomer
agauggcagcagcucauuuuc

SEQ ID NO: 2410 - RNA, 21 nt, artificial
  Oligomer
cucauuuucuuuaauaggagg

SEQ ID NO: 2411 - RNA, 21 nt, artificial
  Oligomer
uuuucuuuaauaggaggucag

SEQ ID NO: 2412 - RNA, 21 nt, artificial
  Oligomer
uaauaggaggucaggaugguc

SEQ ID NO: 2413 - RNA, 21 nt, artificial
  Oligomer
uggugaucuauucauucugug

SEQ ID NO: 2414 - RNA, 21 nt, artificial
  Oligomer
cugauuccggaggaggaauuc

SEQ ID NO: 2415 - RNA, 21 nt, artificial
  Oligomer
aagacgaucagaagggauggc

SEQ ID NO: 2416 - RNA, 21 nt, artificial
  Oligomer
auccugagccguucgagauag

SEQ ID NO: 2417 - RNA, 21 nt, artificial
  Oligomer
acuauggauguggaacuguca

SEQ ID NO: 2418 - RNA, 21 nt, artificial
  Oligomer
cagcugucaguaucuguagcc

SEQ ID NO: 2419 - RNA, 21 nt, artificial
  Oligomer
aguaucuguagccaagcaugg

SEQ ID NO: 2420 - RNA, 21 nt, artificial
  Oligomer
uaacugcccacaaaagauggc

SEQ ID NO: 2421 - RNA, 21 nt, artificial
  Oligomer
aacugcccacaaaagauggca

SEQ ID NO: 2422 - RNA, 21 nt, artificial
  Oligomer
auggucagcuccaguaucucc

SEQ ID NO: 2423 - RNA, 21 nt, artificial
  Oligomer
uuuaccucuagccuuuuggug

SEQ ID NO: 2424 - RNA, 21 nt, artificial
  Oligomer
uaccucuagccuuuugguggg

SEQ ID NO: 2425 - RNA, 21 nt, artificial
  Oligomer
ucugugauucuucagagccca

SEQ ID NO: 2426 - RNA, 21 nt, artificial
  Oligomer
ugaucuauucauucugugacc

SEQ ID NO: 2427 - RNA, 21 nt, artificial
  Oligomer
aagcagcaguuauggagcuuc

SEQ ID NO: 2428 - RNA, 21 nt, artificial
  Oligomer
ggaucucgauauagaccacgg

SEQ ID NO: 2429 - RNA, 21 nt, artificial
  Oligomer
caucagaccaugcacuaugga

SEQ ID NO: 2430 - RNA, 21 nt, artificial
  Oligomer
agaaguuuucacccuccuuca

SEQ ID NO: 2431 - RNA, 21 nt, artificial
  Oligomer
caagcaugggaaucuuugcuc

SEQ ID NO: 2432 - RNA, 21 nt, artificial
  Oligomer
cauuuucuuuaauaggagguc

SEQ ID NO: 2433 - RNA, 21 nt, artificial
  Oligomer
cuuuaccucuagccuuuuggu

SEQ ID NO: 2434 - RNA, 21 nt, artificial
  Oligomer
ccugaaguccuucagaagugc

SEQ ID NO: 2435 - RNA, 21 nt, artificial
  Oligomer
gaaacucucgaagacgaucag

SEQ ID NO: 2436 - RNA, 21 nt, artificial
  Oligomer
aaacucucgaagacgaucaga

SEQ ID NO: 2437 - RNA, 21 nt, artificial
  Oligomer
ugguguucacuccaaucaccu

SEQ ID NO: 2438 - RNA, 21 nt, artificial
  Oligomer
cugaagcagcaguuauggagc

SEQ ID NO: 2439 - RNA, 21 nt, artificial
  Oligomer
guaucuguagccaagcauggg

SEQ ID NO: 2440 - RNA, 21 nt, artificial
  Oligomer
gcuuuaccucuagccuuuugg

SEQ ID NO: 2441 - RNA, 21 nt, artificial
  Oligomer
auucauucugugaccucaggg

SEQ ID NO: 2442 - RNA, 21 nt, artificial
  Oligomer
cucgaagacgaucagaaggga

SEQ ID NO: 2443 - RNA, 21 nt, artificial
  Oligomer
gaaguccuucagaagugcacg

SEQ ID NO: 2444 - RNA, 21 nt, artificial
  Oligomer
gaccaugcacuauggaugugg

SEQ ID NO: 2445 - RNA, 21 nt, artificial
  Oligomer
aggccagcugucaguaucugu

SEQ ID NO: 2446 - RNA, 21 nt, artificial
  Oligomer
agcugucaguaucuguagcca

SEQ ID NO: 2447 - RNA, 21 nt, artificial
  Oligomer
acugcccacaaaagauggcag

SEQ ID NO: 2448 - RNA, 21 nt, artificial
  Oligomer
uucuuuaauaggaggucagga

SEQ ID NO: 2449 - RNA, 21 nt, artificial
  Oligomer
gauacagcuuuaccucuagcc

SEQ ID NO: 2450 - RNA, 21 nt, artificial
  Oligomer
cugaaguccuucagaagugca

SEQ ID NO: 2451 - RNA, 21 nt, artificial
  Oligomer
agacgaucagaagggauggca

SEQ ID NO: 2452 - RNA, 21 nt, artificial
  Oligomer
augggaaucuuugcucccagg

SEQ ID NO: 2453 - RNA, 21 nt, artificial
  Oligomer
aauaggaggucaggaugguca

SEQ ID NO: 2454 - RNA, 21 nt, artificial
  Oligomer
agcauuuuguaccaucugcuc

SEQ ID NO: 2455 - RNA, 21 nt, artificial
  Oligomer
caaaggagauuccagcuguga

SEQ ID NO: 2456 - RNA, 21 nt, artificial
  Oligomer
aucuguagccaagcaugggaa

SEQ ID NO: 2457 - RNA, 21 nt, artificial
  Oligomer
uagccaagcaugggaaucuuu

SEQ ID NO: 2458 - RNA, 21 nt, artificial
  Oligomer
gcauuuuguaccaucugcucc

SEQ ID NO: 2459 - RNA, 21 nt, artificial
  Oligomer
ugugaccuucaugguguucac

SEQ ID NO: 2460 - RNA, 21 nt, artificial
  Oligomer
cagaccaugcacuauggaugu

SEQ ID NO: 2461 - RNA, 21 nt, artificial
  Oligomer
agggauggcaaaggagauucc

SEQ ID NO: 2462 - RNA, 21 nt, artificial
  Oligomer
aaggagauuccagcugugacc

SEQ ID NO: 2463 - RNA, 21 nt, artificial
  Oligomer
gaccuucaugguguucacucc

SEQ ID NO: 2464 - RNA, 21 nt, artificial
  Oligomer
accuucaugguguucacucca

SEQ ID NO: 2465 - RNA, 21 nt, artificial
  Oligomer
uauucauucugugaccucagg

SEQ ID NO: 2466 - RNA, 21 nt, artificial
  Oligomer
cuauucauucugugaccucag

SEQ ID NO: 2467 - RNA, 21 nt, artificial
  Oligomer
auggcaaaggagauuccagcu

SEQ ID NO: 2468 - RNA, 21 nt, artificial
  Oligomer
aggagauuccagcugugaccu

SEQ ID NO: 2469 - RNA, 21 nt, artificial
  Oligomer
agucugaauccucagcguugc

SEQ ID NO: 2470 - RNA, 21 nt, artificial
  Oligomer
accaugcacuauggaugugga

SEQ ID NO: 2471 - RNA, 21 nt, artificial
  Oligomer
aggaaaucagagcaggagccu

SEQ ID NO: 2472 - RNA, 19 nt, artificial
  Oligomer
ggaacgaguggcgaaugau

SEQ ID NO: 2473 - RNA, 19 nt, artificial
  Oligomer
gggcaaaaauacaguccaa

SEQ ID NO: 2474 - RNA, 19 nt, artificial
  Oligomer
agaggaacgaguggcgaau

SEQ ID NO: 2475 - RNA, 19 nt, artificial
  Oligomer
ggaguaucauuguuuuugu

SEQ ID NO: 2476 - RNA, 19 nt, artificial
  Oligomer
gccucauugaauucgccua

SEQ ID NO: 2477 - RNA, 19 nt, artificial
  Oligomer
ggcaaaaauacaguccaau

SEQ ID NO: 2478 - RNA, 19 nt, artificial
  Oligomer
ggaugccucaguguuaaaa

SEQ ID NO: 2479 - RNA, 19 nt, artificial
  Oligomer
cgggacuaaaagaaaagac

SEQ ID NO: 2480 - RNA, 19 nt, artificial
  Oligomer
ucauugaauucgccuacac

SEQ ID NO: 2481 - RNA, 19 nt, artificial
  Oligomer
gcacugcaaauaacccauc

SEQ ID NO: 2482 - RNA, 19 nt, artificial
  Oligomer
gggacuaaaagaaaagaca

SEQ ID NO: 2483 - RNA, 19 nt, artificial
  Oligomer
ccgggacuaaaagaaaaga

SEQ ID NO: 2484 - RNA, 19 nt, artificial
  Oligomer
agaaaagacagcacugcaa

SEQ ID NO: 2485 - RNA, 19 nt, artificial
  Oligomer
cucauugaauucgccuaca

SEQ ID NO: 2486 - RNA, 19 nt, artificial
  Oligomer
ugauaaguaacccuguaau

SEQ ID NO: 2487 - RNA, 19 nt, artificial
  Oligomer
uggugguguugcuuaucuu

SEQ ID NO: 2488 - RNA, 19 nt, artificial
  Oligomer
gggaguaucauuguuuuug

SEQ ID NO: 2489 - RNA, 19 nt, artificial
  Oligomer
uguugcuuaucuucuggaa

SEQ ID NO: 2490 - RNA, 19 nt, artificial
  Oligomer
ccucauugaauucgccuac

SEQ ID NO: 2491 - RNA, 19 nt, artificial
  Oligomer
caccaugugauuuauucuu

SEQ ID NO: 2492 - RNA, 19 nt, artificial
  Oligomer
acugcaaauaacccaucuu

SEQ ID NO: 2493 - RNA, 19 nt, artificial
  Oligomer
cuaaaagaaaagacagcac

SEQ ID NO: 2494 - RNA, 19 nt, artificial
  Oligomer
gcaaaaauacaguccaaug

SEQ ID NO: 2495 - RNA, 19 nt, artificial
  Oligomer
uccugcacaacuguaucua

SEQ ID NO: 2496 - RNA, 19 nt, artificial
  Oligomer
cccgggaguacaucuacau

SEQ ID NO: 2497 - RNA, 19 nt, artificial
  Oligomer
cugucuucaaggccauguu

SEQ ID NO: 2498 - RNA, 19 nt, artificial
  Oligomer
agaacagacuaacuagugu

SEQ ID NO: 2499 - RNA, 19 nt, artificial
  Oligomer
cacugcaaauaacccaucu

SEQ ID NO: 2500 - RNA, 19 nt, artificial
  Oligomer
ggacuaaaagaaaagacag

SEQ ID NO: 2501 - RNA, 19 nt, artificial
  Oligomer
accgggacuaaaagaaaag

SEQ ID NO: 2502 - RNA, 19 nt, artificial
  Oligomer
ccugcacaacuguaucuau

SEQ ID NO: 2503 - RNA, 19 nt, artificial
  Oligomer
ccucaaucgucuccuuuau

SEQ ID NO: 2504 - RNA, 19 nt, artificial
  Oligomer
ucauguaccagaucgacag

SEQ ID NO: 2505 - RNA, 19 nt, artificial
  Oligomer
guguugcuuaucuucugga

SEQ ID NO: 2506 - RNA, 19 nt, artificial
  Oligomer
ugguguugcuuaucuucug

SEQ ID NO: 2507 - RNA, 19 nt, artificial
  Oligomer
ccaugugauuuauucuugg

SEQ ID NO: 2508 - RNA, 19 nt, artificial
  Oligomer
gcagcugucaccaugugau

SEQ ID NO: 2509 - RNA, 19 nt, artificial
  Oligomer
caucucaaaagaaguccaa

SEQ ID NO: 2510 - RNA, 19 nt, artificial
  Oligomer
agcacugcaaauaacccau

SEQ ID NO: 2511 - RNA, 19 nt, artificial
  Oligomer
aaccgggacuaaaagaaaa

SEQ ID NO: 2512 - RNA, 19 nt, artificial
  Oligomer
acaaaaaccgggacuaaaa

SEQ ID NO: 2513 - RNA, 19 nt, artificial
  Oligomer
guacaaaaaccgggacuaa

SEQ ID NO: 2514 - RNA, 19 nt, artificial
  Oligomer
ugaggcacuuuuguuucuu

SEQ ID NO: 2515 - RNA, 19 nt, artificial
  Oligomer
ccuuaauucagcugagugu

SEQ ID NO: 2516 - RNA, 19 nt, artificial
  Oligomer
acaguguggagagguauga

SEQ ID NO: 2517 - RNA, 19 nt, artificial
  Oligomer
agguggugguguugcuuau

SEQ ID NO: 2518 - RNA, 19 nt, artificial
  Oligomer
cgccucauugaauucgccu

SEQ ID NO: 2519 - RNA, 19 nt, artificial
  Oligomer
guguuaaaaugacaucuca

SEQ ID NO: 2520 - RNA, 19 nt, artificial
  Oligomer
aggaugccucaguguuaaa

SEQ ID NO: 2521 - RNA, 19 nt, artificial
  Oligomer
acgucacacugcaggucaa

SEQ ID NO: 2522 - RNA, 19 nt, artificial
  Oligomer
cgauguggaaacagagacg

SEQ ID NO: 2523 - RNA, 19 nt, artificial
  Oligomer
cgcuacgauguggaaacag

SEQ ID NO: 2524 - RNA, 19 nt, artificial
  Oligomer
agcgcuacgauguggaaac

SEQ ID NO: 2525 - RNA, 19 nt, artificial
  Oligomer
guccugcacaacuguaucu

SEQ ID NO: 2526 - RNA, 19 nt, artificial
  Oligomer
caacaguguggagagguau

SEQ ID NO: 2527 - RNA, 19 nt, artificial
  Oligomer
ugcaucaacugggucaagu

SEQ ID NO: 2528 - RNA, 19 nt, artificial
  Oligomer
gaacggugcugucauguac

SEQ ID NO: 2529 - RNA, 19 nt, artificial
  Oligomer
uccaaggaaaauaaagaac

SEQ ID NO: 2530 - RNA, 19 nt, artificial
  Oligomer
uugauaaguaacccuguaa

SEQ ID NO: 2531 - RNA, 19 nt, artificial
  Oligomer
uggacaguuauuuuguuga

SEQ ID NO: 2532 - RNA, 19 nt, artificial
  Oligomer
guacauagaagccaccgga

SEQ ID NO: 2533 - RNA, 19 nt, artificial
  Oligomer
ucaguguuaaaaugacauc

SEQ ID NO: 2534 - RNA, 19 nt, artificial
  Oligomer
cucaguguuaaaaugacau

SEQ ID NO: 2535 - RNA, 19 nt, artificial
  Oligomer
caaaaauacaguccaaugg

SEQ ID NO: 2536 - RNA, 19 nt, artificial
  Oligomer
ucaaguacgacugcgaaca

SEQ ID NO: 2537 - RNA, 19 nt, artificial
  Oligomer
agauuggcuguguggaguu

SEQ ID NO: 2538 - RNA, 19 nt, artificial
  Oligomer
ugaacggugcugucaugua

SEQ ID NO: 2539 - RNA, 19 nt, artificial
  Oligomer
ggagcgccucauugaauuc

SEQ ID NO: 2540 - RNA, 19 nt, artificial
  Oligomer
gguguccauugaggguauc

SEQ ID NO: 2541 - RNA, 19 nt, artificial
  Oligomer
aguguuaaaaugacaucuc

SEQ ID NO: 2542 - RNA, 19 nt, artificial
  Oligomer
caguguuaaaaugacaucu

SEQ ID NO: 2543 - RNA, 19 nt, artificial
  Oligomer
ccucaguguuaaaaugaca

SEQ ID NO: 2544 - RNA, 19 nt, artificial
  Oligomer
uguacaaaaaccgggacua

SEQ ID NO: 2545 - RNA, 19 nt, artificial
  Oligomer
gcacuuuuguuucuugggc

SEQ ID NO: 2546 - RNA, 19 nt, artificial
  Oligomer
gaggcacuuuuguuucuug

SEQ ID NO: 2547 - RNA, 19 nt, artificial
  Oligomer
acaguguggaguguuacga

SEQ ID NO: 2548 - RNA, 19 nt, artificial
  Oligomer
ccuuuggcaucaugaacga

SEQ ID NO: 2549 - RNA, 19 nt, artificial
  Oligomer
acuuuuguuucuugggcaa

SEQ ID NO: 2550 - RNA, 19 nt, artificial
  Oligomer
gcagauugaccagcagaac

SEQ ID NO: 2551 - RNA, 19 nt, artificial
  Oligomer
ggacaguguggaguguuac

SEQ ID NO: 2552 - RNA, 19 nt, artificial
  Oligomer
ggaaacagagacguggacu

SEQ ID NO: 2553 - RNA, 19 nt, artificial
  Oligomer
uggaaacagagacguggac

SEQ ID NO: 2554 - RNA, 19 nt, artificial
  Oligomer
gauuuauucuuggauaccu

SEQ ID NO: 2555 - RNA, 19 nt, artificial
  Oligomer
uuuguuucuugggcaaaaa

SEQ ID NO: 2556 - RNA, 19 nt, artificial
  Oligomer
cacuuuuguuucuugggca

SEQ ID NO: 2557 - RNA, 19 nt, artificial
  Oligomer
cuggacaguguggaguguu

SEQ ID NO: 2558 - RNA, 19 nt, artificial
  Oligomer
ccgggaguacaucuacaug

SEQ ID NO: 2559 - RNA, 19 nt, artificial
  Oligomer
ccaaggaaaauaaagaaca

SEQ ID NO: 2560 - RNA, 19 nt, artificial
  Oligomer
ggaaaauaaagaacagacu

SEQ ID NO: 2561 - RNA, 19 nt, artificial
  Oligomer
uggcgaaugaucacagcaa

SEQ ID NO: 2562 - RNA, 19 nt, artificial
  Oligomer
ccggauggacaguuauuuu

SEQ ID NO: 2563 - RNA, 19 nt, artificial
  Oligomer
agcaggccuuuggcaucau

SEQ ID NO: 2564 - RNA, 19 nt, artificial
  Oligomer
gugcugucauguaccagau

SEQ ID NO: 2565 - RNA, 19 nt, artificial
  Oligomer
caaggaaaauaaagaacag

SEQ ID NO: 2566 - RNA, 19 nt, artificial
  Oligomer
gcugucaccaugugauuua

SEQ ID NO: 2567 - RNA, 19 nt, artificial
  Oligomer
ccgccuuaauucagcugag

SEQ ID NO: 2568 - RNA, 19 nt, artificial
  Oligomer
ggaggaucauaccaagcag

SEQ ID NO: 2569 - RNA, 19 nt, artificial
  Oligomer
ugguguccauugaggguau

SEQ ID NO: 2570 - RNA, 19 nt, artificial
  Oligomer
cggauggacaguuauuuug

SEQ ID NO: 2571 - RNA, 19 nt, artificial
  Oligomer
gccucaguguuaaaaugac

SEQ ID NO: 2572 - RNA, 19 nt, artificial
  Oligomer
gcguccugcacaacuguau

SEQ ID NO: 2573 - RNA, 19 nt, artificial
  Oligomer
cgaguggcgaaugaucaca

SEQ ID NO: 2574 - RNA, 19 nt, artificial
  Oligomer
cccuggaggaucauaccaa

SEQ ID NO: 2575 - RNA, 19 nt, artificial
  Oligomer
ggauggacaguuauuuugu

SEQ ID NO: 2576 - RNA, 19 nt, artificial
  Oligomer
gcaaugaacaccauccgaa

SEQ ID NO: 2577 - RNA, 19 nt, artificial
  Oligomer
aggaaaauaaagaacagac

SEQ ID NO: 2578 - RNA, 19 nt, artificial
  Oligomer
ccuguaauuuuccaaggaa

SEQ ID NO: 2579 - RNA, 19 nt, artificial
  Oligomer
ccaccggauggacaguuau

SEQ ID NO: 2580 - RNA, 19 nt, artificial
  Oligomer
agaaguccaaagcgggaau

SEQ ID NO: 2581 - RNA, 19 nt, artificial
  Oligomer
cgggacaaaccgccuuaau

SEQ ID NO: 2582 - RNA, 19 nt, artificial
  Oligomer
acacccuggaggaucauac

SEQ ID NO: 2583 - RNA, 19 nt, artificial
  Oligomer
cuacacccuggaggaucau

SEQ ID NO: 2584 - RNA, 19 nt, artificial
  Oligomer
ugagcagauuggcugugug

SEQ ID NO: 2585 - RNA, 19 nt, artificial
  Oligomer
guaccagaucgacagcguu

SEQ ID NO: 2586 - RNA, 19 nt, artificial
  Oligomer
gugguguccauugagggua

SEQ ID NO: 2587 - RNA, 19 nt, artificial
  Oligomer
cccuguaauuuuccaagga

SEQ ID NO: 2588 - RNA, 19 nt, artificial
  Oligomer
uaacccuguaauuuuccaa

SEQ ID NO: 2589 - RNA, 19 nt, artificial
  Oligomer
guaacccuguaauuuucca

SEQ ID NO: 2590 - RNA, 19 nt, artificial
  Oligomer
ucauaccaagcaggccuuu

SEQ ID NO: 2591 - RNA, 19 nt, artificial
  Oligomer
cgccuuaauucagcugagu

SEQ ID NO: 2592 - RNA, 19 nt, artificial
  Oligomer
accgccuuaauucagcuga

SEQ ID NO: 2593 - RNA, 19 nt, artificial
  Oligomer
ucgucuccuuuaugccgug

SEQ ID NO: 2594 - RNA, 19 nt, artificial
  Oligomer
uggaggaucauaccaagca

SEQ ID NO: 2595 - RNA, 19 nt, artificial
  Oligomer
ucaucgauggccacaucua

SEQ ID NO: 2596 - RNA, 19 nt, artificial
  Oligomer
gcuaccuggaggcuuacaa

SEQ ID NO: 2597 - RNA, 19 nt, artificial
  Oligomer
agcaagaggaguucuucaa

SEQ ID NO: 2598 - RNA, 19 nt, artificial
  Oligomer
aguacaucuacaugcauuu

SEQ ID NO: 2599 - RNA, 19 nt, artificial
  Oligomer
cugagcagauuggcugugu

SEQ ID NO: 2600 - RNA, 19 nt, artificial
  Oligomer
cagacuaacuagugucuuu

SEQ ID NO: 2601 - RNA, 19 nt, artificial
  Oligomer
ggaguguuacgacccagau

SEQ ID NO: 2602 - RNA, 19 nt, artificial
  Oligomer
uggagagguaugagccaga

SEQ ID NO: 2603 - RNA, 19 nt, artificial
  Oligomer
ccaugaccaaucagugguc

SEQ ID NO: 2604 - RNA, 19 nt, artificial
  Oligomer
agcugcagaagugcgagau

SEQ ID NO: 2605 - RNA, 19 nt, artificial
  Oligomer
agaugcagcugcagaagug

SEQ ID NO: 2606 - RNA, 19 nt, artificial
  Oligomer
cuguaauuuuccaaggaaa

SEQ ID NO: 2607 - RNA, 19 nt, artificial
  Oligomer
cugucaccaugugauuuau

SEQ ID NO: 2608 - RNA, 19 nt, artificial
  Oligomer
cagcugucaccaugugauu

SEQ ID NO: 2609 - RNA, 19 nt, artificial
  Oligomer
gaccagcagaacuguaccu

SEQ ID NO: 2610 - RNA, 19 nt, artificial
  Oligomer
gggagaaucuacguccuug

SEQ ID NO: 2611 - RNA, 19 nt, artificial
  Oligomer
acgggacaaaccgccuuaa

SEQ ID NO: 2612 - RNA, 19 nt, artificial
  Oligomer
cccaugaccaaucaguggu

SEQ ID NO: 2613 - RNA, 19 nt, artificial
  Oligomer
aggaguucuucaaccuguc

SEQ ID NO: 2614 - RNA, 19 nt, artificial
  Oligomer
gcaagaggaguucuucaac

SEQ ID NO: 2615 - RNA, 19 nt, artificial
  Oligomer
ccaagcaagaggaguucuu

SEQ ID NO: 2616 - RNA, 19 nt, artificial
  Oligomer
gaaguccaaagcgggaauc

SEQ ID NO: 2617 - RNA, 19 nt, artificial
  Oligomer
ggcuaugauggucacacgu

SEQ ID NO: 2618 - RNA, 19 nt, artificial
  Oligomer
ggagaaucuacguccuugg

SEQ ID NO: 2619 - RNA, 19 nt, artificial
  Oligomer
cgaacuuccugcagaugca

SEQ ID NO: 2620 - RNA, 19 nt, artificial
  Oligomer
ccugcaucaacugggucaa

SEQ ID NO: 2621 - RNA, 19 nt, artificial
  Oligomer
uggccaagcaagaggaguu

SEQ ID NO: 2622 - RNA, 19 nt, artificial
  Oligomer
cugucauguaccagaucga

SEQ ID NO: 2623 - RNA, 19 nt, artificial
  Oligomer
ggugcugucauguaccaga

SEQ ID NO: 2624 - RNA, 19 nt, artificial
  Oligomer
accggauggacaguuauuu

SEQ ID NO: 2625 - RNA, 19 nt, artificial
  Oligomer
gccuguacauagaagccac

SEQ ID NO: 2626 - RNA, 19 nt, artificial
  Oligomer
ugggcaaaaauacagucca

SEQ ID NO: 2627 - RNA, 19 nt, artificial
  Oligomer
aggccuuuggcaucaugaa

SEQ ID NO: 2628 - RNA, 19 nt, artificial
  Oligomer
uccucaaucgucuccuuua

SEQ ID NO: 2629 - RNA, 19 nt, artificial
  Oligomer
ccuggaggaucauaccaag

SEQ ID NO: 2630 - RNA, 19 nt, artificial
  Oligomer
guacaucuacaugcauuuu

SEQ ID NO: 2631 - RNA, 19 nt, artificial
  Oligomer
acagacuaacuagugucuu

SEQ ID NO: 2632 - RNA, 19 nt, artificial
  Oligomer
ggccuguacauagaagcca

SEQ ID NO: 2633 - RNA, 19 nt, artificial
  Oligomer
cuguaccuguugaggcacu

SEQ ID NO: 2634 - RNA, 19 nt, artificial
  Oligomer
ccagauacagacaccugga

SEQ ID NO: 2635 - RNA, 19 nt, artificial
  Oligomer
cguccuuggaggcuaugau

SEQ ID NO: 2636 - RNA, 19 nt, artificial
  Oligomer
cacaacuguaucuaugcug

SEQ ID NO: 2637 - RNA, 19 nt, artificial
  Oligomer
ccaacuucgcugagcagau

SEQ ID NO: 2638 - RNA, 19 nt, artificial
  Oligomer
acggugcugucauguacca

SEQ ID NO: 2639 - RNA, 19 nt, artificial
  Oligomer
aguguguccuccacgucau

SEQ ID NO: 2640 - RNA, 19 nt, artificial
  Oligomer
agaaguguguccuccacgu

SEQ ID NO: 2641 - RNA, 19 nt, artificial
  Oligomer
uggaggugguguccauuga

SEQ ID NO: 2642 - RNA, 19 nt, artificial
  Oligomer
agacuaacuagugucuuuc

SEQ ID NO: 2643 - RNA, 19 nt, artificial
  Oligomer
gaacagacuaacuaguguc

SEQ ID NO: 2644 - RNA, 19 nt, artificial
  Oligomer
caggucaaguaccaggaug

SEQ ID NO: 2645 - RNA, 19 nt, artificial
  Oligomer
cagaacuguaccuguugag

SEQ ID NO: 2646 - RNA, 19 nt, artificial
  Oligomer
ccagcagaacuguaccugu

SEQ ID NO: 2647 - RNA, 19 nt, artificial
  Oligomer
gccuuaauucagcugagug

SEQ ID NO: 2648 - RNA, 19 nt, artificial
  Oligomer
guccucaaucgucuccuuu

SEQ ID NO: 2649 - RNA, 19 nt, artificial
  Oligomer
uguccucaaucgucuccuu

SEQ ID NO: 2650 - RNA, 19 nt, artificial
  Oligomer
gaggaguucuucaaccugu

SEQ ID NO: 2651 - RNA, 19 nt, artificial
  Oligomer
gacuaacuagugucuuuca

SEQ ID NO: 2652 - RNA, 19 nt, artificial
  Oligomer
caccggauggacaguuauu

SEQ ID NO: 2653 - RNA, 19 nt, artificial
  Oligomer
gucaccaugugauuuauuc

SEQ ID NO: 2654 - RNA, 19 nt, artificial
  Oligomer
acaucucaaaagaagucca

SEQ ID NO: 2655 - RNA, 19 nt, artificial
  Oligomer
ugacaucucaaaagaaguc

SEQ ID NO: 2656 - RNA, 19 nt, artificial
  Oligomer
cuguugaggcacuuuuguu

SEQ ID NO: 2657 - RNA, 19 nt, artificial
  Oligomer
guaccuguugaggcacuuu

SEQ ID NO: 2658 - RNA, 19 nt, artificial
  Oligomer
uguaccuguugaggcacuu

SEQ ID NO: 2659 - RNA, 19 nt, artificial
  Oligomer
gaagcagauugaccagcag

SEQ ID NO: 2660 - RNA, 19 nt, artificial
  Oligomer
cagauacagacaccuggag

SEQ ID NO: 2661 - RNA, 19 nt, artificial
  Oligomer
uggaguguuacgacccaga

SEQ ID NO: 2662 - RNA, 19 nt, artificial
  Oligomer
acacguuccuggacagugu

SEQ ID NO: 2663 - RNA, 19 nt, artificial
  Oligomer
ggaggcuaugauggucaca

SEQ ID NO: 2664 - RNA, 19 nt, artificial
  Oligomer
cugaguguuacuacccaga

SEQ ID NO: 2665 - RNA, 19 nt, artificial
  Oligomer
gcugaguguuacuacccag

SEQ ID NO: 2666 - RNA, 19 nt, artificial
  Oligomer
ccugucuucaaggccaugu

SEQ ID NO: 2667 - RNA, 19 nt, artificial
  Oligomer
acccuguaauuuuccaagg

SEQ ID NO: 2668 - RNA, 19 nt, artificial
  Oligomer
ugucaccaugugauuuauu

SEQ ID NO: 2669 - RNA, 19 nt, artificial
  Oligomer
uaccuguugaggcacuuuu

SEQ ID NO: 2670 - RNA, 19 nt, artificial
  Oligomer
agauugaccagcagaacug

SEQ ID NO: 2671 - RNA, 19 nt, artificial
  Oligomer
agcagauugaccagcagaa

SEQ ID NO: 2672 - RNA, 19 nt, artificial
  Oligomer
ggaagcagauugaccagca

SEQ ID NO: 2673 - RNA, 19 nt, artificial
  Oligomer
gaggcuaugauggucacac

SEQ ID NO: 2674 - RNA, 19 nt, artificial
  Oligomer
agcugaguguuacuaccca

SEQ ID NO: 2675 - RNA, 19 nt, artificial
  Oligomer
ggucaaguacgacugcgaa

SEQ ID NO: 2676 - RNA, 19 nt, artificial
  Oligomer
acaucuacaugcauuuugg

SEQ ID NO: 2677 - RNA, 19 nt, artificial
  Oligomer
guguccuccacgucaugaa

SEQ ID NO: 2678 - RNA, 19 nt, artificial
  Oligomer
gccuuuggcaucaugaacg

SEQ ID NO: 2679 - RNA, 19 nt, artificial
  Oligomer
uggaggcuaugauggucac

SEQ ID NO: 2680 - RNA, 19 nt, artificial
  Oligomer
ggccuuuggcaucaugaac

SEQ ID NO: 2681 - RNA, 19 nt, artificial
  Oligomer
ugcaaggacuaccugguca

SEQ ID NO: 2682 - RNA, 19 nt, artificial
  Oligomer
cgggaguacaucuacaugc

SEQ ID NO: 2683 - RNA, 19 nt, artificial
  Oligomer
ucaugaacggugcugucau

SEQ ID NO: 2684 - RNA, 19 nt, artificial
  Oligomer
cccucuggaaaugugguuc

SEQ ID NO: 2685 - RNA, 19 nt, artificial
  Oligomer
agcugugugacgucacacu

SEQ ID NO: 2686 - RNA, 19 nt, artificial
  Oligomer
cuaugauggucacacguuc

SEQ ID NO: 2687 - RNA, 19 nt, artificial
  Oligomer
gaaaugugguucccaggga

SEQ ID NO: 2688 - RNA, 19 nt, artificial
  Oligomer
cuggaaaugugguucccag

SEQ ID NO: 2689 - RNA, 19 nt, artificial
  Oligomer
cuaugauggucaggaccag

SEQ ID NO: 2690 - RNA, 19 nt, artificial
  Oligomer
cacugcaggucaaguacca

SEQ ID NO: 2691 - RNA, 19 nt, artificial
  Oligomer
uguugaggcacuuuuguuu

SEQ ID NO: 2692 - RNA, 19 nt, artificial
  Oligomer
agagacguggacuuucgua

SEQ ID NO: 2693 - RNA, 19 nt, artificial
  Oligomer
gccaagcaagaggaguucu

SEQ ID NO: 2694 - RNA, 19 nt, artificial
  Oligomer
aaaugugguucccagggau

SEQ ID NO: 2695 - RNA, 19 nt, artificial
  Oligomer
uggcuguccucaaucgucu

SEQ ID NO: 2696 - RNA, 19 nt, artificial
  Oligomer
ugcagaugcagcugcagaa

SEQ ID NO: 2697 - RNA, 19 nt, artificial
  Oligomer
aucauucgccacucguucc

SEQ ID NO: 2698 - RNA, 19 nt, artificial
  Oligomer
uuggacuguauuuuugccc

SEQ ID NO: 2699 - RNA, 19 nt, artificial
  Oligomer
auucgccacucguuccucu

SEQ ID NO: 2700 - RNA, 19 nt, artificial
  Oligomer
acaaaaacaaugauacucc

SEQ ID NO: 2701 - RNA, 19 nt, artificial
  Oligomer
uaggcgaauucaaugaggc

SEQ ID NO: 2702 - RNA, 19 nt, artificial
  Oligomer
auuggacuguauuuuugcc

SEQ ID NO: 2703 - RNA, 19 nt, artificial
  Oligomer
uuuuaacacugaggcaucc

SEQ ID NO: 2704 - RNA, 19 nt, artificial
  Oligomer
gucuuuucuuuuagucccg

SEQ ID NO: 2705 - RNA, 19 nt, artificial
  Oligomer
guguaggcgaauucaauga

SEQ ID NO: 2706 - RNA, 19 nt, artificial
  Oligomer
gauggguuauuugcagugc

SEQ ID NO: 2707 - RNA, 19 nt, artificial
  Oligomer
ugucuuuucuuuuaguccc

SEQ ID NO: 2708 - RNA, 19 nt, artificial
  Oligomer
ucuuuucuuuuagucccgg

SEQ ID NO: 2709 - RNA, 19 nt, artificial
  Oligomer
uugcagugcugucuuuucu

SEQ ID NO: 2710 - RNA, 19 nt, artificial
  Oligomer
uguaggcgaauucaaugag

SEQ ID NO: 2711 - RNA, 19 nt, artificial
  Oligomer
auuacaggguuacuuauca

SEQ ID NO: 2712 - RNA, 19 nt, artificial
  Oligomer
aagauaagcaacaccacca

SEQ ID NO: 2713 - RNA, 19 nt, artificial
  Oligomer
caaaaacaaugauacuccc

SEQ ID NO: 2714 - RNA, 19 nt, artificial
  Oligomer
uuccagaagauaagcaaca

SEQ ID NO: 2715 - RNA, 19 nt, artificial
  Oligomer
guaggcgaauucaaugagg

SEQ ID NO: 2716 - RNA, 19 nt, artificial
  Oligomer
aagaauaaaucacauggug

SEQ ID NO: 2717 - RNA, 19 nt, artificial
  Oligomer
aagauggguuauuugcagu

SEQ ID NO: 2718 - RNA, 19 nt, artificial
  Oligomer
gugcugucuuuucuuuuag

SEQ ID NO: 2719 - RNA, 19 nt, artificial
  Oligomer
cauuggacuguauuuuugc

SEQ ID NO: 2720 - RNA, 19 nt, artificial
  Oligomer
uagauacaguugugcagga

SEQ ID NO: 2721 - RNA, 19 nt, artificial
  Oligomer
auguagauguacucccggg

SEQ ID NO: 2722 - RNA, 19 nt, artificial
  Oligomer
aacauggccuugaagacag

SEQ ID NO: 2723 - RNA, 19 nt, artificial
  Oligomer
acacuaguuagucuguucu

SEQ ID NO: 2724 - RNA, 19 nt, artificial
  Oligomer
agauggguuauuugcagug

SEQ ID NO: 2725 - RNA, 19 nt, artificial
  Oligomer
cugucuuuucuuuuagucc

SEQ ID NO: 2726 - RNA, 19 nt, artificial
  Oligomer
cuuuucuuuuagucccggu

SEQ ID NO: 2727 - RNA, 19 nt, artificial
  Oligomer
auagauacaguugugcagg

SEQ ID NO: 2728 - RNA, 19 nt, artificial
  Oligomer
auaaaggagacgauugagg

SEQ ID NO: 2729 - RNA, 19 nt, artificial
  Oligomer
cugucgaucugguacauga

SEQ ID NO: 2730 - RNA, 19 nt, artificial
  Oligomer
uccagaagauaagcaacac

SEQ ID NO: 2731 - RNA, 19 nt, artificial
  Oligomer
cagaagauaagcaacacca

SEQ ID NO: 2732 - RNA, 19 nt, artificial
  Oligomer
ccaagaauaaaucacaugg

SEQ ID NO: 2733 - RNA, 19 nt, artificial
  Oligomer
aucacauggugacagcugc

SEQ ID NO: 2734 - RNA, 19 nt, artificial
  Oligomer
uuggacuucuuuugagaug

SEQ ID NO: 2735 - RNA, 19 nt, artificial
  Oligomer
auggguuauuugcagugcu

SEQ ID NO: 2736 - RNA, 19 nt, artificial
  Oligomer
uuuucuuuuagucccgguu

SEQ ID NO: 2737 - RNA, 19 nt, artificial
  Oligomer
uuuuagucccgguuuuugu

SEQ ID NO: 2738 - RNA, 19 nt, artificial
  Oligomer
uuagucccgguuuuuguac

SEQ ID NO: 2739 - RNA, 19 nt, artificial
  Oligomer
aagaaacaaaagugccuca

SEQ ID NO: 2740 - RNA, 19 nt, artificial
  Oligomer
acacucagcugaauuaagg

SEQ ID NO: 2741 - RNA, 19 nt, artificial
  Oligomer
ucauaccucuccacacugu

SEQ ID NO: 2742 - RNA, 19 nt, artificial
  Oligomer
auaagcaacaccaccaccu

SEQ ID NO: 2743 - RNA, 19 nt, artificial
  Oligomer
aggcgaauucaaugaggcg

SEQ ID NO: 2744 - RNA, 19 nt, artificial
  Oligomer
ugagaugucauuuuaacac

SEQ ID NO: 2745 - RNA, 19 nt, artificial
  Oligomer
uuuaacacugaggcauccu

SEQ ID NO: 2746 - RNA, 19 nt, artificial
  Oligomer
uugaccugcagugugacgu

SEQ ID NO: 2747 - RNA, 19 nt, artificial
  Oligomer
cgucucuguuuccacaucg

SEQ ID NO: 2748 - RNA, 19 nt, artificial
  Oligomer
cuguuuccacaucguagcg

SEQ ID NO: 2749 - RNA, 19 nt, artificial
  Oligomer
guuuccacaucguagcgcu

SEQ ID NO: 2750 - RNA, 19 nt, artificial
  Oligomer
agauacaguugugcaggac

SEQ ID NO: 2751 - RNA, 19 nt, artificial
  Oligomer
auaccucuccacacuguug

SEQ ID NO: 2752 - RNA, 19 nt, artificial
  Oligomer
acuugacccaguugaugca

SEQ ID NO: 2753 - RNA, 19 nt, artificial
  Oligomer
guacaugacagcaccguuc

SEQ ID NO: 2754 - RNA, 19 nt, artificial
  Oligomer
guucuuuauuuuccuugga

SEQ ID NO: 2755 - RNA, 19 nt, artificial
  Oligomer
uuacaggguuacuuaucaa

SEQ ID NO: 2756 - RNA, 19 nt, artificial
  Oligomer
ucaacaaaauaacugucca

SEQ ID NO: 2757 - RNA, 19 nt, artificial
  Oligomer
uccgguggcuucuauguac

SEQ ID NO: 2758 - RNA, 19 nt, artificial
  Oligomer
gaugucauuuuaacacuga

SEQ ID NO: 2759 - RNA, 19 nt, artificial
  Oligomer
augucauuuuaacacugag

SEQ ID NO: 2760 - RNA, 19 nt, artificial
  Oligomer
ccauuggacuguauuuuug

SEQ ID NO: 2761 - RNA, 19 nt, artificial
  Oligomer
uguucgcagucguacuuga

SEQ ID NO: 2762 - RNA, 19 nt, artificial
  Oligomer
aacuccacacagccaaucu

SEQ ID NO: 2763 - RNA, 19 nt, artificial
  Oligomer
uacaugacagcaccguuca

SEQ ID NO: 2764 - RNA, 19 nt, artificial
  Oligomer
gaauucaaugaggcgcucc

SEQ ID NO: 2765 - RNA, 19 nt, artificial
  Oligomer
gauacccucaauggacacc

SEQ ID NO: 2766 - RNA, 19 nt, artificial
  Oligomer
gagaugucauuuuaacacu

SEQ ID NO: 2767 - RNA, 19 nt, artificial
  Oligomer
agaugucauuuuaacacug

SEQ ID NO: 2768 - RNA, 19 nt, artificial
  Oligomer
ugucauuuuaacacugagg

SEQ ID NO: 2769 - RNA, 19 nt, artificial
  Oligomer
uagucccgguuuuuguaca

SEQ ID NO: 2770 - RNA, 19 nt, artificial
  Oligomer
gcccaagaaacaaaagugc

SEQ ID NO: 2771 - RNA, 19 nt, artificial
  Oligomer
caagaaacaaaagugccuc

SEQ ID NO: 2772 - RNA, 19 nt, artificial
  Oligomer
ucguaacacuccacacugu

SEQ ID NO: 2773 - RNA, 19 nt, artificial
  Oligomer
ucguucaugaugccaaagg

SEQ ID NO: 2774 - RNA, 19 nt, artificial
  Oligomer
uugcccaagaaacaaaagu

SEQ ID NO: 2775 - RNA, 19 nt, artificial
  Oligomer
guucugcuggucaaucugc

SEQ ID NO: 2776 - RNA, 19 nt, artificial
  Oligomer
guaacacuccacacugucc

SEQ ID NO: 2777 - RNA, 19 nt, artificial
  Oligomer
aguccacgucucuguuucc

SEQ ID NO: 2778 - RNA, 19 nt, artificial
  Oligomer
guccacgucucuguuucca

SEQ ID NO: 2779 - RNA, 19 nt, artificial
  Oligomer
agguauccaagaauaaauc

SEQ ID NO: 2780 - RNA, 19 nt, artificial
  Oligomer
uuuuugcccaagaaacaaa

SEQ ID NO: 2781 - RNA, 19 nt, artificial
  Oligomer
ugcccaagaaacaaaagug

SEQ ID NO: 2782 - RNA, 19 nt, artificial
  Oligomer
aacacuccacacuguccag

SEQ ID NO: 2783 - RNA, 19 nt, artificial
  Oligomer
cauguagauguacucccgg

SEQ ID NO: 2784 - RNA, 19 nt, artificial
  Oligomer
uguucuuuauuuuccuugg

SEQ ID NO: 2785 - RNA, 19 nt, artificial
  Oligomer
agucuguucuuuauuuucc

SEQ ID NO: 2786 - RNA, 19 nt, artificial
  Oligomer
uugcugugaucauucgcca

SEQ ID NO: 2787 - RNA, 19 nt, artificial
  Oligomer
aaaauaacuguccauccgg

SEQ ID NO: 2788 - RNA, 19 nt, artificial
  Oligomer
augaugccaaaggccugcu

SEQ ID NO: 2789 - RNA, 19 nt, artificial
  Oligomer
aucugguacaugacagcac

SEQ ID NO: 2790 - RNA, 19 nt, artificial
  Oligomer
cuguucuuuauuuuccuug

SEQ ID NO: 2791 - RNA, 19 nt, artificial
  Oligomer
uaaaucacauggugacagc

SEQ ID NO: 2792 - RNA, 19 nt, artificial
  Oligomer
cucagcugaauuaaggcgg

SEQ ID NO: 2793 - RNA, 19 nt, artificial
  Oligomer
cugcuugguaugauccucc

SEQ ID NO: 2794 - RNA, 19 nt, artificial
  Oligomer
auacccucaauggacacca

SEQ ID NO: 2795 - RNA, 19 nt, artificial
  Oligomer
caaaauaacuguccauccg

SEQ ID NO: 2796 - RNA, 19 nt, artificial
  Oligomer
gucauuuuaacacugaggc

SEQ ID NO: 2797 - RNA, 19 nt, artificial
  Oligomer
auacaguugugcaggacgc

SEQ ID NO: 2798 - RNA, 19 nt, artificial
  Oligomer
ugugaucauucgccacucg

SEQ ID NO: 2799 - RNA, 19 nt, artificial
  Oligomer
uugguaugauccuccaggg

SEQ ID NO: 2800 - RNA, 19 nt, artificial
  Oligomer
acaaaauaacuguccaucc

SEQ ID NO: 2801 - RNA, 19 nt, artificial
  Oligomer
uucggaugguguucauugc

SEQ ID NO: 2802 - RNA, 19 nt, artificial
  Oligomer
gucuguucuuuauuuuccu

SEQ ID NO: 2803 - RNA, 19 nt, artificial
  Oligomer
uuccuuggaaaauuacagg

SEQ ID NO: 2804 - RNA, 19 nt, artificial
  Oligomer
auaacuguccauccggugg

SEQ ID NO: 2805 - RNA, 19 nt, artificial
  Oligomer
auucccgcuuuggacuucu

SEQ ID NO: 2806 - RNA, 19 nt, artificial
  Oligomer
auuaaggcgguuugucccg

SEQ ID NO: 2807 - RNA, 19 nt, artificial
  Oligomer
guaugauccuccagggugu

SEQ ID NO: 2808 - RNA, 19 nt, artificial
  Oligomer
augauccuccaggguguag

SEQ ID NO: 2809 - RNA, 19 nt, artificial
  Oligomer
cacacagccaaucugcuca

SEQ ID NO: 2810 - RNA, 19 nt, artificial
  Oligomer
aacgcugucgaucugguac

SEQ ID NO: 2811 - RNA, 19 nt, artificial
  Oligomer
uacccucaauggacaccac

SEQ ID NO: 2812 - RNA, 19 nt, artificial
  Oligomer
uccuuggaaaauuacaggg

SEQ ID NO: 2813 - RNA, 19 nt, artificial
  Oligomer
uuggaaaauuacaggguua

SEQ ID NO: 2814 - RNA, 19 nt, artificial
  Oligomer
uggaaaauuacaggguuac

SEQ ID NO: 2815 - RNA, 19 nt, artificial
  Oligomer
aaaggccugcuugguauga

SEQ ID NO: 2816 - RNA, 19 nt, artificial
  Oligomer
acucagcugaauuaaggcg

SEQ ID NO: 2817 - RNA, 19 nt, artificial
  Oligomer
ucagcugaauuaaggcggu

SEQ ID NO: 2818 - RNA, 19 nt, artificial
  Oligomer
cacggcauaaaggagacga

SEQ ID NO: 2819 - RNA, 19 nt, artificial
  Oligomer
ugcuugguaugauccucca

SEQ ID NO: 2820 - RNA, 19 nt, artificial
  Oligomer
uagauguggccaucgauga

SEQ ID NO: 2821 - RNA, 19 nt, artificial
  Oligomer
uuguaagccuccagguagc

SEQ ID NO: 2822 - RNA, 19 nt, artificial
  Oligomer
uugaagaacuccucuugcu

SEQ ID NO: 2823 - RNA, 19 nt, artificial
  Oligomer
aaaugcauguagauguacu

SEQ ID NO: 2824 - RNA, 19 nt, artificial
  Oligomer
acacagccaaucugcucag

SEQ ID NO: 2825 - RNA, 19 nt, artificial
  Oligomer
aaagacacuaguuagucug

SEQ ID NO: 2826 - RNA, 19 nt, artificial
  Oligomer
aucugggucguaacacucc

SEQ ID NO: 2827 - RNA, 19 nt, artificial
  Oligomer
ucuggcucauaccucucca

SEQ ID NO: 2828 - RNA, 19 nt, artificial
  Oligomer
gaccacugauuggucaugg

SEQ ID NO: 2829 - RNA, 19 nt, artificial
  Oligomer
aucucgcacuucugcagcu

SEQ ID NO: 2830 - RNA, 19 nt, artificial
  Oligomer
cacuucugcagcugcaucu

SEQ ID NO: 2831 - RNA, 19 nt, artificial
  Oligomer
uuuccuuggaaaauuacag

SEQ ID NO: 2832 - RNA, 19 nt, artificial
  Oligomer
auaaaucacauggugacag

SEQ ID NO: 2833 - RNA, 19 nt, artificial
  Oligomer
aaucacauggugacagcug

SEQ ID NO: 2834 - RNA, 19 nt, artificial
  Oligomer
agguacaguucugcugguc

SEQ ID NO: 2835 - RNA, 19 nt, artificial
  Oligomer
caaggacguagauucuccc

SEQ ID NO: 2836 - RNA, 19 nt, artificial
  Oligomer
uuaaggcgguuugucccgu

SEQ ID NO: 2837 - RNA, 19 nt, artificial
  Oligomer
accacugauuggucauggg

SEQ ID NO: 2838 - RNA, 19 nt, artificial
  Oligomer
gacagguugaagaacuccu

SEQ ID NO: 2839 - RNA, 19 nt, artificial
  Oligomer
guugaagaacuccucuugc

SEQ ID NO: 2840 - RNA, 19 nt, artificial
  Oligomer
aagaacuccucuugcuugg

SEQ ID NO: 2841 - RNA, 19 nt, artificial
  Oligomer
gauucccgcuuuggacuuc

SEQ ID NO: 2842 - RNA, 19 nt, artificial
  Oligomer
acgugugaccaucauagcc

SEQ ID NO: 2843 - RNA, 19 nt, artificial
  Oligomer
ccaaggacguagauucucc

SEQ ID NO: 2844 - RNA, 19 nt, artificial
  Oligomer
ugcaucugcaggaaguucg

SEQ ID NO: 2845 - RNA, 19 nt, artificial
  Oligomer
uugacccaguugaugcagg

SEQ ID NO: 2846 - RNA, 19 nt, artificial
  Oligomer
aacuccucuugcuuggcca

SEQ ID NO: 2847 - RNA, 19 nt, artificial
  Oligomer
ucgaucugguacaugacag

SEQ ID NO: 2848 - RNA, 19 nt, artificial
  Oligomer
ucugguacaugacagcacc

SEQ ID NO: 2849 - RNA, 19 nt, artificial
  Oligomer
aaauaacuguccauccggu

SEQ ID NO: 2850 - RNA, 19 nt, artificial
  Oligomer
guggcuucuauguacaggc

SEQ ID NO: 2851 - RNA, 19 nt, artificial
  Oligomer
uggacuguauuuuugccca

SEQ ID NO: 2852 - RNA, 19 nt, artificial
  Oligomer
uucaugaugccaaaggccu

SEQ ID NO: 2853 - RNA, 19 nt, artificial
  Oligomer
uaaaggagacgauugagga

SEQ ID NO: 2854 - RNA, 19 nt, artificial
  Oligomer
cuugguaugauccuccagg

SEQ ID NO: 2855 - RNA, 19 nt, artificial
  Oligomer
aaaaugcauguagauguac

SEQ ID NO: 2856 - RNA, 19 nt, artificial
  Oligomer
aagacacuaguuagucugu

SEQ ID NO: 2857 - RNA, 19 nt, artificial
  Oligomer
uggcuucuauguacaggcc

SEQ ID NO: 2858 - RNA, 19 nt, artificial
  Oligomer
agugccucaacagguacag

SEQ ID NO: 2859 - RNA, 19 nt, artificial
  Oligomer
uccaggugucuguaucugg

SEQ ID NO: 2860 - RNA, 19 nt, artificial
  Oligomer
aucauagccuccaaggacg

SEQ ID NO: 2861 - RNA, 19 nt, artificial
  Oligomer
cagcauagauacaguugug

SEQ ID NO: 2862 - RNA, 19 nt, artificial
  Oligomer
aucugcucagcgaaguugg

SEQ ID NO: 2863 - RNA, 19 nt, artificial
  Oligomer
ugguacaugacagcaccgu

SEQ ID NO: 2864 - RNA, 19 nt, artificial
  Oligomer
augacguggaggacacacu

SEQ ID NO: 2865 - RNA, 19 nt, artificial
  Oligomer
acguggaggacacacuucu

SEQ ID NO: 2866 - RNA, 19 nt, artificial
  Oligomer
ucaauggacaccaccucca

SEQ ID NO: 2867 - RNA, 19 nt, artificial
  Oligomer
gaaagacacuaguuagucu

SEQ ID NO: 2868 - RNA, 19 nt, artificial
  Oligomer
gacacuaguuagucuguuc

SEQ ID NO: 2869 - RNA, 19 nt, artificial
  Oligomer
cauccugguacuugaccug

SEQ ID NO: 2870 - RNA, 19 nt, artificial
  Oligomer
cucaacagguacaguucug

SEQ ID NO: 2871 - RNA, 19 nt, artificial
  Oligomer
acagguacaguucugcugg

SEQ ID NO: 2872 - RNA, 19 nt, artificial
  Oligomer
cacucagcugaauuaaggc

SEQ ID NO: 2873 - RNA, 19 nt, artificial
  Oligomer
aaaggagacgauugaggac

SEQ ID NO: 2874 - RNA, 19 nt, artificial
  Oligomer
aaggagacgauugaggaca

SEQ ID NO: 2875 - RNA, 19 nt, artificial
  Oligomer
acagguugaagaacuccuc

SEQ ID NO: 2876 - RNA, 19 nt, artificial
  Oligomer
ugaaagacacuaguuaguc

SEQ ID NO: 2877 - RNA, 19 nt, artificial
  Oligomer
aauaacuguccauccggug

SEQ ID NO: 2878 - RNA, 19 nt, artificial
  Oligomer
gaauaaaucacauggugac

SEQ ID NO: 2879 - RNA, 19 nt, artificial
  Oligomer
uggacuucuuuugagaugu

SEQ ID NO: 2880 - RNA, 19 nt, artificial
  Oligomer
gacuucuuuugagauguca

SEQ ID NO: 2881 - RNA, 19 nt, artificial
  Oligomer
aacaaaagugccucaacag

SEQ ID NO: 2882 - RNA, 19 nt, artificial
  Oligomer
aaagugccucaacagguac

SEQ ID NO: 2883 - RNA, 19 nt, artificial
  Oligomer
aagugccucaacagguaca

SEQ ID NO: 2884 - RNA, 19 nt, artificial
  Oligomer
cugcuggucaaucugcuuc

SEQ ID NO: 2885 - RNA, 19 nt, artificial
  Oligomer
cuccaggugucuguaucug

SEQ ID NO: 2886 - RNA, 19 nt, artificial
  Oligomer
ucugggucguaacacucca

SEQ ID NO: 2887 - RNA, 19 nt, artificial
  Oligomer
acacuguccaggaacgugu

SEQ ID NO: 2888 - RNA, 19 nt, artificial
  Oligomer
ugugaccaucauagccucc

SEQ ID NO: 2889 - RNA, 19 nt, artificial
  Oligomer
ucuggguaguaacacucag

SEQ ID NO: 2890 - RNA, 19 nt, artificial
  Oligomer
cuggguaguaacacucagc

SEQ ID NO: 2891 - RNA, 19 nt, artificial
  Oligomer
acauggccuugaagacagg

SEQ ID NO: 2892 - RNA, 19 nt, artificial
  Oligomer
ccuuggaaaauuacagggu

SEQ ID NO: 2893 - RNA, 19 nt, artificial
  Oligomer
aauaaaucacauggugaca

SEQ ID NO: 2894 - RNA, 19 nt, artificial
  Oligomer
aaaagugccucaacaggua

SEQ ID NO: 2895 - RNA, 19 nt, artificial
  Oligomer
caguucugcuggucaaucu

SEQ ID NO: 2896 - RNA, 19 nt, artificial
  Oligomer
uucugcuggucaaucugcu

SEQ ID NO: 2897 - RNA, 19 nt, artificial
  Oligomer
ugcuggucaaucugcuucc

SEQ ID NO: 2898 - RNA, 19 nt, artificial
  Oligomer
gugugaccaucauagccuc

SEQ ID NO: 2899 - RNA, 19 nt, artificial
  Oligomer
uggguaguaacacucagcu

SEQ ID NO: 2900 - RNA, 19 nt, artificial
  Oligomer
uucgcagucguacuugacc

SEQ ID NO: 2901 - RNA, 19 nt, artificial
  Oligomer
ccaaaaugcauguagaugu

SEQ ID NO: 2902 - RNA, 19 nt, artificial
  Oligomer
uucaugacguggaggacac

SEQ ID NO: 2903 - RNA, 19 nt, artificial
  Oligomer
cguucaugaugccaaaggc

SEQ ID NO: 2904 - RNA, 19 nt, artificial
  Oligomer
gugaccaucauagccucca

SEQ ID NO: 2905 - RNA, 19 nt, artificial
  Oligomer
guucaugaugccaaaggcc

SEQ ID NO: 2906 - RNA, 19 nt, artificial
  Oligomer
ugaccagguaguccuugca

SEQ ID NO: 2907 - RNA, 19 nt, artificial
  Oligomer
gcauguagauguacucccg

SEQ ID NO: 2908 - RNA, 19 nt, artificial
  Oligomer
augacagcaccguucauga

SEQ ID NO: 2909 - RNA, 19 nt, artificial
  Oligomer
gaaccacauuuccagaggg

SEQ ID NO: 2910 - RNA, 19 nt, artificial
  Oligomer
agugugacgucacacagcu

SEQ ID NO: 2911 - RNA, 19 nt, artificial
  Oligomer
gaacgugugaccaucauag

SEQ ID NO: 2912 - RNA, 19 nt, artificial
  Oligomer
ucccugggaaccacauuuc

SEQ ID NO: 2913 - RNA, 19 nt, artificial
  Oligomer
cugggaaccacauuuccag

SEQ ID NO: 2914 - RNA, 19 nt, artificial
  Oligomer
cugguccugaccaucauag

SEQ ID NO: 2915 - RNA, 19 nt, artificial
  Oligomer
ugguacuugaccugcagug

SEQ ID NO: 2916 - RNA, 19 nt, artificial
  Oligomer
aaacaaaagugccucaaca

SEQ ID NO: 2917 - RNA, 19 nt, artificial
  Oligomer
uacgaaaguccacgucucu

SEQ ID NO: 2918 - RNA, 19 nt, artificial
  Oligomer
agaacuccucuugcuuggc

SEQ ID NO: 2919 - RNA, 19 nt, artificial
  Oligomer
aucccugggaaccacauuu

SEQ ID NO: 2920 - RNA, 19 nt, artificial
  Oligomer
agacgauugaggacagcca

SEQ ID NO: 2921 - RNA, 19 nt, artificial
  Oligomer
uucugcagcugcaucugca

SEQ ID NO: 2922 - RNA, 21 nt, artificial
  Oligomer
gaggaacgaguggcgaaugau

SEQ ID NO: 2923 - RNA, 21 nt, artificial
  Oligomer
gcacugcaaauaacccaucuu

SEQ ID NO: 2924 - RNA, 21 nt, artificial
  Oligomer
gggaguaucauuguuuuugua

SEQ ID NO: 2925 - RNA, 21 nt, artificial
  Oligomer
ggaacgaguggcgaaugauca

SEQ ID NO: 2926 - RNA, 21 nt, artificial
  Oligomer
ggaguaucauuguuuuuguac

SEQ ID NO: 2927 - RNA, 21 nt, artificial
  Oligomer
agagaggaacgaguggcgaau

SEQ ID NO: 2928 - RNA, 21 nt, artificial
  Oligomer
gcagauuggcuguguggaguu

SEQ ID NO: 2929 - RNA, 21 nt, artificial
  Oligomer
gguguugcuuaucuucuggaa

SEQ ID NO: 2930 - RNA, 21 nt, artificial
  Oligomer
ccucauugaauucgccuacac

SEQ ID NO: 2931 - RNA, 21 nt, artificial
  Oligomer
gccucauugaauucgccuaca

SEQ ID NO: 2932 - RNA, 21 nt, artificial
  Oligomer
ccaugugauuuauucuuggau

SEQ ID NO: 2933 - RNA, 21 nt, artificial
  Oligomer
gcacuuuuguuucuugggcaa

SEQ ID NO: 2934 - RNA, 21 nt, artificial
  Oligomer
gguggugguguugcuuaucuu

SEQ ID NO: 2935 - RNA, 21 nt, artificial
  Oligomer
ggaaacagagacguggacuuu

SEQ ID NO: 2936 - RNA, 21 nt, artificial
  Oligomer
cgccucauugaauucgccuac

SEQ ID NO: 2937 - RNA, 21 nt, artificial
  Oligomer
ggacuaaaagaaaagacagca

SEQ ID NO: 2938 - RNA, 21 nt, artificial
  Oligomer
cgggacuaaaagaaaagacag

SEQ ID NO: 2939 - RNA, 21 nt, artificial
  Oligomer
ccgggacuaaaagaaaagaca

SEQ ID NO: 2940 - RNA, 21 nt, artificial
  Oligomer
gggcaaaaauacaguccaaug

SEQ ID NO: 2941 - RNA, 21 nt, artificial
  Oligomer
cugcaucaacugggucaagua

SEQ ID NO: 2942 - RNA, 21 nt, artificial
  Oligomer
guacaaaaaccgggacuaaaa

SEQ ID NO: 2943 - RNA, 21 nt, artificial
  Oligomer
gggaugggccuguacauagaa

SEQ ID NO: 2944 - RNA, 21 nt, artificial
  Oligomer
gaaaagacagcacugcaaaua

SEQ ID NO: 2945 - RNA, 21 nt, artificial
  Oligomer
agaaaagacagcacugcaaau

SEQ ID NO: 2946 - RNA, 21 nt, artificial
  Oligomer
gcaaaaauacaguccaauggg

SEQ ID NO: 2947 - RNA, 21 nt, artificial
  Oligomer
cgauguggaaacagagacgug

SEQ ID NO: 2948 - RNA, 21 nt, artificial
  Oligomer
cgcuacgauguggaaacagag

SEQ ID NO: 2949 - RNA, 21 nt, artificial
  Oligomer
guccugcacaacuguaucuau

SEQ ID NO: 2950 - RNA, 21 nt, artificial
  Oligomer
aagaaaagacagcacugcaaa

SEQ ID NO: 2951 - RNA, 21 nt, artificial
  Oligomer
cuaaaagaaaagacagcacug

SEQ ID NO: 2952 - RNA, 21 nt, artificial
  Oligomer
cuuuuguuucuugggcaaaaa

SEQ ID NO: 2953 - RNA, 21 nt, artificial
  Oligomer
guguugcuuaucuucuggaac

SEQ ID NO: 2954 - RNA, 21 nt, artificial
  Oligomer
ugauuuauucuuggauaccug

SEQ ID NO: 2955 - RNA, 21 nt, artificial
  Oligomer
ggcagcugucaccaugugauu

SEQ ID NO: 2956 - RNA, 21 nt, artificial
  Oligomer
guggugguguugcuuaucuuc

SEQ ID NO: 2957 - RNA, 21 nt, artificial
  Oligomer
acagcacugcaaauaacccau

SEQ ID NO: 2958 - RNA, 21 nt, artificial
  Oligomer
gacuaaaagaaaagacagcac

SEQ ID NO: 2959 - RNA, 21 nt, artificial
  Oligomer
ugguguugcuuaucuucugga

SEQ ID NO: 2960 - RNA, 21 nt, artificial
  Oligomer
uguugauaaguaacccuguaa

SEQ ID NO: 2961 - RNA, 21 nt, artificial
  Oligomer
cucauccagcccugucuucaa

SEQ ID NO: 2962 - RNA, 21 nt, artificial
  Oligomer
cacugcaaauaacccaucuuc

SEQ ID NO: 2963 - RNA, 21 nt, artificial
  Oligomer
agcacugcaaauaacccaucu

SEQ ID NO: 2964 - RNA, 21 nt, artificial
  Oligomer
accgggacuaaaagaaaagac

SEQ ID NO: 2965 - RNA, 21 nt, artificial
  Oligomer
caaaaaccgggacuaaaagaa

SEQ ID NO: 2966 - RNA, 21 nt, artificial
  Oligomer
cacuuuuguuucuugggcaaa

SEQ ID NO: 2967 - RNA, 21 nt, artificial
  Oligomer
ggcacuuuuguuucuugggca

SEQ ID NO: 2968 - RNA, 21 nt, artificial
  Oligomer
gcgcuacgauguggaaacaga

SEQ ID NO: 2969 - RNA, 21 nt, artificial
  Oligomer
ccuuaauucagcugaguguua

SEQ ID NO: 2970 - RNA, 21 nt, artificial
  Oligomer
guugauaaguaacccuguaau

SEQ ID NO: 2971 - RNA, 21 nt, artificial
  Oligomer
accaugugauuuauucuugga

SEQ ID NO: 2972 - RNA, 21 nt, artificial
  Oligomer
caguguuaaaaugacaucuca

SEQ ID NO: 2973 - RNA, 21 nt, artificial
  Oligomer
ucaguguuaaaaugacaucuc

SEQ ID NO: 2974 - RNA, 21 nt, artificial
  Oligomer
aaaaaccgggacuaaaagaaa

SEQ ID NO: 2975 - RNA, 21 nt, artificial
  Oligomer
agcgcuacgauguggaaacag

SEQ ID NO: 2976 - RNA, 21 nt, artificial
  Oligomer
gagcgcuacgauguggaaaca

SEQ ID NO: 2977 - RNA, 21 nt, artificial
  Oligomer
gcagcugucaccaugugauuu

SEQ ID NO: 2978 - RNA, 21 nt, artificial
  Oligomer
uuguacaaaaaccgggacuaa

SEQ ID NO: 2979 - RNA, 21 nt, artificial
  Oligomer
ggcaaaaauacaguccaaugg

SEQ ID NO: 2980 - RNA, 21 nt, artificial
  Oligomer
ggacaguguggaguguuacga

SEQ ID NO: 2981 - RNA, 21 nt, artificial
  Oligomer
ugcccgggaguacaucuacau

SEQ ID NO: 2982 - RNA, 21 nt, artificial
  Oligomer
ccucaguguuaaaaugacauc

SEQ ID NO: 2983 - RNA, 21 nt, artificial
  Oligomer
cuggacaguguggaguguuac

SEQ ID NO: 2984 - RNA, 21 nt, artificial
  Oligomer
ccuggacaguguggaguguua

SEQ ID NO: 2985 - RNA, 21 nt, artificial
  Oligomer
uggaaacagagacguggacuu

SEQ ID NO: 2986 - RNA, 21 nt, artificial
  Oligomer
uuaauucagcugaguguuacu

SEQ ID NO: 2987 - RNA, 21 nt, artificial
  Oligomer
uccucaaucgucuccuuuaug

SEQ ID NO: 2988 - RNA, 21 nt, artificial
  Oligomer
guccucaaucgucuccuuuau

SEQ ID NO: 2989 - RNA, 21 nt, artificial
  Oligomer
gugguguccauugaggguauc

SEQ ID NO: 2990 - RNA, 21 nt, artificial
  Oligomer
ggaugggccuguacauagaag

SEQ ID NO: 2991 - RNA, 21 nt, artificial
  Oligomer
cucaguguuaaaaugacaucu

SEQ ID NO: 2992 - RNA, 21 nt, artificial
  Oligomer
guugaggcacuuuuguuucuu

SEQ ID NO: 2993 - RNA, 21 nt, artificial
  Oligomer
ccuuggaggcuaugaugguca

SEQ ID NO: 2994 - RNA, 21 nt, artificial
  Oligomer
guggaaacagagacguggacu

SEQ ID NO: 2995 - RNA, 21 nt, artificial
  Oligomer
ugauggucacacguuccugga

SEQ ID NO: 2996 - RNA, 21 nt, artificial
  Oligomer
caagcaggccuuuggcaucau

SEQ ID NO: 2997 - RNA, 21 nt, artificial
  Oligomer
aggaugccucaguguuaaaau

SEQ ID NO: 2998 - RNA, 21 nt, artificial
  Oligomer
ccaggaugccucaguguuaaa

SEQ ID NO: 2999 - RNA, 21 nt, artificial
  Oligomer
ggaguacaucuacaugcauuu

SEQ ID NO: 3000 - RNA, 21 nt, artificial
  Oligomer
ccaaggaaaauaaagaacaga

SEQ ID NO: 3001 - RNA, 21 nt, artificial
  Oligomer
guggcgaaugaucacagcaau

SEQ ID NO: 3002 - RNA, 21 nt, artificial
  Oligomer
ggaucauaccaagcaggccuu

SEQ ID NO: 3003 - RNA, 21 nt, artificial
  Oligomer
ggauggacaguuauuuuguug

SEQ ID NO: 3004 - RNA, 21 nt, artificial
  Oligomer
ccggauggacaguuauuuugu

SEQ ID NO: 3005 - RNA, 21 nt, artificial
  Oligomer
gccucaguguuaaaaugacau

SEQ ID NO: 3006 - RNA, 21 nt, artificial
  Oligomer
aaaagacagcacugcaaauaa

SEQ ID NO: 3007 - RNA, 21 nt, artificial
  Oligomer
gcgaaugaucacagcaaugaa

SEQ ID NO: 3008 - RNA, 21 nt, artificial
  Oligomer
gaaguguguccuccacgucau

SEQ ID NO: 3009 - RNA, 21 nt, artificial
  Oligomer
cggauggacaguuauuuuguu

SEQ ID NO: 3010 - RNA, 21 nt, artificial
  Oligomer
cugcaggucaaguaccaggau

SEQ ID NO: 3011 - RNA, 21 nt, artificial
  Oligomer
gcugucaccaugugauuuauu

SEQ ID NO: 3012 - RNA, 21 nt, artificial
  Oligomer
ggaugccucaguguuaaaaug

SEQ ID NO: 3013 - RNA, 21 nt, artificial
  Oligomer
agcaggccuuuggcaucauga

SEQ ID NO: 3014 - RNA, 21 nt, artificial
  Oligomer
uggcgaaugaucacagcaaug

SEQ ID NO: 3015 - RNA, 21 nt, artificial
  Oligomer
caaggaaaauaaagaacagac

SEQ ID NO: 3016 - RNA, 21 nt, artificial
  Oligomer
uccaaggaaaauaaagaacag

SEQ ID NO: 3017 - RNA, 21 nt, artificial
  Oligomer
agcugucaccaugugauuuau

SEQ ID NO: 3018 - RNA, 21 nt, artificial
  Oligomer
ccgccuuaauucagcugagug

SEQ ID NO: 3019 - RNA, 21 nt, artificial
  Oligomer
agcuacacccuggaggaucau

SEQ ID NO: 3020 - RNA, 21 nt, artificial
  Oligomer
gcaagaggaguucuucaaccu

SEQ ID NO: 3021 - RNA, 21 nt, artificial
  Oligomer
ggugcugucauguaccagauc

SEQ ID NO: 3022 - RNA, 21 nt, artificial
  Oligomer
cggugcugucauguaccagau

SEQ ID NO: 3023 - RNA, 21 nt, artificial
  Oligomer
agagguggugguguugcuuau

SEQ ID NO: 3024 - RNA, 21 nt, artificial
  Oligomer
ggugguguccauugaggguau

SEQ ID NO: 3025 - RNA, 21 nt, artificial
  Oligomer
gagguggugguguugcuuauc

SEQ ID NO: 3026 - RNA, 21 nt, artificial
  Oligomer
cccuguaauuuuccaaggaaa

SEQ ID NO: 3027 - RNA, 21 nt, artificial
  Oligomer
aguaacccuguaauuuuccaa

SEQ ID NO: 3028 - RNA, 21 nt, artificial
  Oligomer
cuguaccuguugaggcacuuu

SEQ ID NO: 3029 - RNA, 21 nt, artificial
  Oligomer
gaguacaucuacaugcauuuu

SEQ ID NO: 3030 - RNA, 21 nt, artificial
  Oligomer
ugcugucauguaccagaucga

SEQ ID NO: 3031 - RNA, 21 nt, artificial
  Oligomer
cuaacuagugucuuucacccu

SEQ ID NO: 3032 - RNA, 21 nt, artificial
  Oligomer
ccaccggauggacaguuauuu

SEQ ID NO: 3033 - RNA, 21 nt, artificial
  Oligomer
gccaggaugccucaguguuaa

SEQ ID NO: 3034 - RNA, 21 nt, artificial
  Oligomer
acuguaccuguugaggcacuu

SEQ ID NO: 3035 - RNA, 21 nt, artificial
  Oligomer
accgccuuaauucagcugagu

SEQ ID NO: 3036 - RNA, 21 nt, artificial
  Oligomer
gggaguacaucuacaugcauu

SEQ ID NO: 3037 - RNA, 21 nt, artificial
  Oligomer
acagacuaacuagugucuuuc

SEQ ID NO: 3038 - RNA, 21 nt, artificial
  Oligomer
cccugucuucaaggccauguu

SEQ ID NO: 3039 - RNA, 21 nt, artificial
  Oligomer
ccuguaauuuuccaaggaaaa

SEQ ID NO: 3040 - RNA, 21 nt, artificial
  Oligomer
cagcugucaccaugugauuua

SEQ ID NO: 3041 - RNA, 21 nt, artificial
  Oligomer
gaucauaccaagcaggccuuu

SEQ ID NO: 3042 - RNA, 21 nt, artificial
  Oligomer
gccuuaauucagcugaguguu

SEQ ID NO: 3043 - RNA, 21 nt, artificial
  Oligomer
ccacaacaguguggagaggua

SEQ ID NO: 3044 - RNA, 21 nt, artificial
  Oligomer
gucaucgauggccacaucuau

SEQ ID NO: 3045 - RNA, 21 nt, artificial
  Oligomer
ggucaucgauggccacaucua

SEQ ID NO: 3046 - RNA, 21 nt, artificial
  Oligomer
aaagaaguccaaagcgggaau

SEQ ID NO: 3047 - RNA, 21 nt, artificial
  Oligomer
agcagaacuguaccuguugag

SEQ ID NO: 3048 - RNA, 21 nt, artificial
  Oligomer
gcaggccuuuggcaucaugaa

SEQ ID NO: 3049 - RNA, 21 nt, artificial
  Oligomer
gggagaaucuacguccuugga

SEQ ID NO: 3050 - RNA, 21 nt, artificial
  Oligomer
ggcgaaugaucacagcaauga

SEQ ID NO: 3051 - RNA, 21 nt, artificial
  Oligomer
gggacaaaccgccuuaauuca

SEQ ID NO: 3052 - RNA, 21 nt, artificial
  Oligomer
cgggaguacaucuacaugcau

SEQ ID NO: 3053 - RNA, 21 nt, artificial
  Oligomer
acccuguaauuuuccaaggaa

SEQ ID NO: 3054 - RNA, 21 nt, artificial
  Oligomer
ugggcaaaaauacaguccaau

SEQ ID NO: 3055 - RNA, 21 nt, artificial
  Oligomer
ccagcagaacuguaccuguug

SEQ ID NO: 3056 - RNA, 21 nt, artificial
  Oligomer
aucuacguccuuggaggcuau

SEQ ID NO: 3057 - RNA, 21 nt, artificial
  Oligomer
gcguccugcacaacuguaucu

SEQ ID NO: 3058 - RNA, 21 nt, artificial
  Oligomer
gacgggacaaaccgccuuaau

SEQ ID NO: 3059 - RNA, 21 nt, artificial
  Oligomer
cccaaugcugacacgaaggau

SEQ ID NO: 3060 - RNA, 21 nt, artificial
  Oligomer
cacaacaguguggagagguau

SEQ ID NO: 3061 - RNA, 21 nt, artificial
  Oligomer
caaggacuaccuggucaagau

SEQ ID NO: 3062 - RNA, 21 nt, artificial
  Oligomer
ugggucaaguacgacugcgaa

SEQ ID NO: 3063 - RNA, 21 nt, artificial
  Oligomer
caagcaagaggaguucuucaa

SEQ ID NO: 3064 - RNA, 21 nt, artificial
  Oligomer
gcgccucauugaauucgccua

SEQ ID NO: 3065 - RNA, 21 nt, artificial
  Oligomer
cuguacauagaagccaccgga

SEQ ID NO: 3066 - RNA, 21 nt, artificial
  Oligomer
acaucucaaaagaaguccaaa

SEQ ID NO: 3067 - RNA, 21 nt, artificial
  Oligomer
accagcagaacuguaccuguu

SEQ ID NO: 3068 - RNA, 21 nt, artificial
  Oligomer
agauugaccagcagaacugua

SEQ ID NO: 3069 - RNA, 21 nt, artificial
  Oligomer
guggaguguuacgacccagau

SEQ ID NO: 3070 - RNA, 21 nt, artificial
  Oligomer
ggcuaugauggucacacguuc

SEQ ID NO: 3071 - RNA, 21 nt, artificial
  Oligomer
aggcuaugauggucacacguu

SEQ ID NO: 3072 - RNA, 21 nt, artificial
  Oligomer
gaggcuaugauggucacacgu

SEQ ID NO: 3073 - RNA, 21 nt, artificial
  Oligomer
ggagaaucuacguccuuggag

SEQ ID NO: 3074 - RNA, 21 nt, artificial
  Oligomer
cguccugcacaacuguaucua

SEQ ID NO: 3075 - RNA, 21 nt, artificial
  Oligomer
gaucacagcaaugaacaccau

SEQ ID NO: 3076 - RNA, 21 nt, artificial
  Oligomer
gaaugaucacagcaaugaaca

SEQ ID NO: 3077 - RNA, 21 nt, artificial
  Oligomer
cgaaugaucacagcaaugaac

SEQ ID NO: 3078 - RNA, 21 nt, artificial
  Oligomer
ccaacuucgcugagcagauug

SEQ ID NO: 3079 - RNA, 21 nt, artificial
  Oligomer
gaacagacuaacuagugucuu

SEQ ID NO: 3080 - RNA, 21 nt, artificial
  Oligomer
cccaccggauggacaguuauu

SEQ ID NO: 3081 - RNA, 21 nt, artificial
  Oligomer
ggaaaugugguucccagggau

SEQ ID NO: 3082 - RNA, 21 nt, artificial
  Oligomer
gaaguccaaagcgggaaucau

SEQ ID NO: 3083 - RNA, 21 nt, artificial
  Oligomer
gacaucucaaaagaaguccaa

SEQ ID NO: 3084 - RNA, 21 nt, artificial
  Oligomer
ggaagcagauugaccagcaga

SEQ ID NO: 3085 - RNA, 21 nt, artificial
  Oligomer
gcacaacuguaucuaugcugc

SEQ ID NO: 3086 - RNA, 21 nt, artificial
  Oligomer
ugaguguuacuacccagagag

SEQ ID NO: 3087 - RNA, 21 nt, artificial
  Oligomer
cgggacaaaccgccuuaauuc

SEQ ID NO: 3088 - RNA, 21 nt, artificial
  Oligomer
ugacgggacaaaccgccuuaa

SEQ ID NO: 3089 - RNA, 21 nt, artificial
  Oligomer
acccuggaggaucauaccaag

SEQ ID NO: 3090 - RNA, 21 nt, artificial
  Oligomer
cuguccucaaucgucuccuuu

SEQ ID NO: 3091 - RNA, 21 nt, artificial
  Oligomer
gcuguccucaaucgucuccuu

SEQ ID NO: 3092 - RNA, 21 nt, artificial
  Oligomer
cagcuaccuggaggcuuacaa

SEQ ID NO: 3093 - RNA, 21 nt, artificial
  Oligomer
caacugggucaaguacgacug

SEQ ID NO: 3094 - RNA, 21 nt, artificial
  Oligomer
ccaagcaagaggaguucuuca

SEQ ID NO: 3095 - RNA, 21 nt, artificial
  Oligomer
cagacuaacuagugucuuuca

SEQ ID NO: 3096 - RNA, 21 nt, artificial
  Oligomer
ccuguugaggcacuuuuguuu

SEQ ID NO: 3097 - RNA, 21 nt, artificial
  Oligomer
ggccuuuggcaucaugaacga

SEQ ID NO: 3098 - RNA, 21 nt, artificial
  Oligomer
acccagauacagacaccugga

SEQ ID NO: 3099 - RNA, 21 nt, artificial
  Oligomer
gaguguuacgacccagauaca

SEQ ID NO: 3100 - RNA, 21 nt, artificial
  Oligomer
ggaguguuacgacccagauac

SEQ ID NO: 3101 - RNA, 21 nt, artificial
  Oligomer
acguccuuggaggcuaugaug

SEQ ID NO: 3102 - RNA, 21 nt, artificial
  Oligomer
cacaacuguaucuaugcugcu

SEQ ID NO: 3103 - RNA, 21 nt, artificial
  Oligomer
cgccuuaauucagcugagugu

SEQ ID NO: 3104 - RNA, 21 nt, artificial
  Oligomer
acgggacaaaccgccuuaauu

SEQ ID NO: 3105 - RNA, 21 nt, artificial
  Oligomer
agcuaccuggaggcuuacaac

SEQ ID NO: 3106 - RNA, 21 nt, artificial
  Oligomer
gcaaggacuaccuggucaaga

SEQ ID NO: 3107 - RNA, 21 nt, artificial
  Oligomer
cugcaaggacuaccuggucaa

SEQ ID NO: 3108 - RNA, 21 nt, artificial
  Oligomer
ccgggaguacaucuacaugca

SEQ ID NO: 3109 - RNA, 21 nt, artificial
  Oligomer
gccaacuucgcugagcagauu

SEQ ID NO: 3110 - RNA, 21 nt, artificial
  Oligomer
gcugucauguaccagaucgac

SEQ ID NO: 3111 - RNA, 21 nt, artificial
  Oligomer
ccugucuucaaggccauguuc

SEQ ID NO: 3112 - RNA, 21 nt, artificial
  Oligomer
agaacagacuaacuagugucu

SEQ ID NO: 3113 - RNA, 21 nt, artificial
  Oligomer
caggucaaguaccaggaugca

SEQ ID NO: 3114 - RNA, 21 nt, artificial
  Oligomer
caggaugccucaguguuaaaa

SEQ ID NO: 3115 - RNA, 21 nt, artificial
  Oligomer
uugggcaaaaauacaguccaa

SEQ ID NO: 3116 - RNA, 21 nt, artificial
  Oligomer
guaccuguugaggcacuuuug

SEQ ID NO: 3117 - RNA, 21 nt, artificial
  Oligomer
gaacuguaccuguugaggcac

SEQ ID NO: 3118 - RNA, 21 nt, artificial
  Oligomer
gcagaacuguaccuguugagg

SEQ ID NO: 3119 - RNA, 21 nt, artificial
  Oligomer
ugcacaacuguaucuaugcug

SEQ ID NO: 3120 - RNA, 21 nt, artificial
  Oligomer
agcaaugaacaccauccgaag

SEQ ID NO: 3121 - RNA, 21 nt, artificial
  Oligomer
guguuacuacccagagaggaa

SEQ ID NO: 3122 - RNA, 21 nt, artificial
  Oligomer
gcugaguguuacuacccagag

SEQ ID NO: 3123 - RNA, 21 nt, artificial
  Oligomer
cuggaggaucauaccaagcag

SEQ ID NO: 3124 - RNA, 21 nt, artificial
  Oligomer
acaaaccgccuuaauucagcu

SEQ ID NO: 3125 - RNA, 21 nt, artificial
  Oligomer
gucaaguacgacugcgaacag

SEQ ID NO: 3126 - RNA, 21 nt, artificial
  Oligomer
agaggaguucuucaaccuguc

SEQ ID NO: 3127 - RNA, 21 nt, artificial
  Oligomer
guguguccuccacgucaugaa

SEQ ID NO: 3128 - RNA, 21 nt, artificial
  Oligomer
guguccauugaggguauccac

SEQ ID NO: 3129 - RNA, 21 nt, artificial
  Oligomer
agacuaacuagugucuuucac

SEQ ID NO: 3130 - RNA, 21 nt, artificial
  Oligomer
ucaccaugugauuuauucuug

SEQ ID NO: 3131 - RNA, 21 nt, artificial
  Oligomer
gcagauugaccagcagaacug

SEQ ID NO: 3132 - RNA, 21 nt, artificial
  Oligomer
gaagcagauugaccagcagaa

SEQ ID NO: 3133 - RNA, 21 nt, artificial
  Oligomer
agauacagacaccuggagcga

SEQ ID NO: 3134 - RNA, 21 nt, artificial
  Oligomer
uggaguguuacgacccagaua

SEQ ID NO: 3135 - RNA, 21 nt, artificial
  Oligomer
ugcguccugcacaacuguauc

SEQ ID NO: 3136 - RNA, 21 nt, artificial
  Oligomer
cugcguccugcacaacuguau

SEQ ID NO: 3137 - RNA, 21 nt, artificial
  Oligomer
cagcaaugaacaccauccgaa

SEQ ID NO: 3138 - RNA, 21 nt, artificial
  Oligomer
ggacaaaccgccuuaauucag

SEQ ID NO: 3139 - RNA, 21 nt, artificial
  Oligomer
accacaacaguguggagaggu

SEQ ID NO: 3140 - RNA, 21 nt, artificial
  Oligomer
ggaguucuucaaccuguccca

SEQ ID NO: 3141 - RNA, 21 nt, artificial
  Oligomer
gccaagcaagaggaguucuuc

SEQ ID NO: 3142 - RNA, 21 nt, artificial
  Oligomer
ggccaagcaagaggaguucuu

SEQ ID NO: 3143 - RNA, 21 nt, artificial
  Oligomer
guacaucuacaugcauuuugg

SEQ ID NO: 3144 - RNA, 21 nt, artificial
  Oligomer
uguacauagaagccaccggau

SEQ ID NO: 3145 - RNA, 21 nt, artificial
  Oligomer
gaaaugugguucccagggaug

SEQ ID NO: 3146 - RNA, 21 nt, artificial
  Oligomer
agaaguccaaagcgggaauca

SEQ ID NO: 3147 - RNA, 21 nt, artificial
  Oligomer
acacugcaggucaaguaccag

SEQ ID NO: 3148 - RNA, 21 nt, artificial
  Oligomer
ugacaucucaaaagaagucca

SEQ ID NO: 3149 - RNA, 21 nt, artificial
  Oligomer
cuguugaggcacuuuuguuuc

SEQ ID NO: 3150 - RNA, 21 nt, artificial
  Oligomer
gccuuuggcaucaugaacgag

SEQ ID NO: 3151 - RNA, 21 nt, artificial
  Oligomer
uccuggacaguguggaguguu

SEQ ID NO: 3152 - RNA, 21 nt, artificial
  Oligomer
ccugcacaacuguaucuaugc

SEQ ID NO: 3153 - RNA, 21 nt, artificial
  Oligomer
ugaucacagcaaugaacacca

SEQ ID NO: 3154 - RNA, 21 nt, artificial
  Oligomer
agcugaguguuacuacccaga

SEQ ID NO: 3155 - RNA, 21 nt, artificial
  Oligomer
cagcugaguguuacuacccag

SEQ ID NO: 3156 - RNA, 21 nt, artificial
  Oligomer
caagaggaguucuucaaccug

SEQ ID NO: 3157 - RNA, 21 nt, artificial
  Oligomer
ucaugaacggugcugucaugu

SEQ ID NO: 3158 - RNA, 21 nt, artificial
  Oligomer
cgucaugaacggugcugucau

SEQ ID NO: 3159 - RNA, 21 nt, artificial
  Oligomer
ugucaccaugugauuuauucu

SEQ ID NO: 3160 - RNA, 21 nt, artificial
  Oligomer
cgucacacugcaggucaagua

SEQ ID NO: 3161 - RNA, 21 nt, artificial
  Oligomer
cagauugaccagcagaacugu

SEQ ID NO: 3162 - RNA, 21 nt, artificial
  Oligomer
ccaaugcugacacgaaggauc

SEQ ID NO: 3163 - RNA, 21 nt, artificial
  Oligomer
ucauggagcgccucauugaau

SEQ ID NO: 3164 - RNA, 21 nt, artificial
  Oligomer
gucaccaugugauuuauucuu

SEQ ID NO: 3165 - RNA, 21 nt, artificial
  Oligomer
ugacgucacacugcaggucaa

SEQ ID NO: 3166 - RNA, 21 nt, artificial
  Oligomer
accuguugaggcacuuuuguu

SEQ ID NO: 3167 - RNA, 21 nt, artificial
  Oligomer
gucauggagcgccucauugaa

SEQ ID NO: 3168 - RNA, 21 nt, artificial
  Oligomer
aaggucauggagcgccucauu

SEQ ID NO: 3169 - RNA, 21 nt, artificial
  Oligomer
ccucuggaaaugugguuccca

SEQ ID NO: 3170 - RNA, 21 nt, artificial
  Oligomer
aaauaacccaucuuccgggaa

SEQ ID NO: 3171 - RNA, 21 nt, artificial
  Oligomer
acagcaaugaacaccauccga

SEQ ID NO: 3172 - RNA, 21 nt, artificial
  Oligomer
cuucaaggccauguucaccaa

SEQ ID NO: 3173 - RNA, 21 nt, artificial
  Oligomer
gucacacugcaggucaaguac

SEQ ID NO: 3174 - RNA, 21 nt, artificial
  Oligomer
acagagacguggacuuucgua

SEQ ID NO: 3175 - RNA, 21 nt, artificial
  Oligomer
caccggauggacaguuauuuu

SEQ ID NO: 3176 - RNA, 21 nt, artificial
  Oligomer
caaauaacccaucuuccggga

SEQ ID NO: 3177 - RNA, 21 nt, artificial
  Oligomer
ugccucaguguuaaaaugaca

SEQ ID NO: 3178 - RNA, 21 nt, artificial
  Oligomer
ugauggucaggaccagcugaa

SEQ ID NO: 3179 - RNA, 21 nt, artificial
  Oligomer
aucauucgccacucguuccuc

SEQ ID NO: 3180 - RNA, 21 nt, artificial
  Oligomer
aagauggguuauuugcagugc

SEQ ID NO: 3181 - RNA, 21 nt, artificial
  Oligomer
uacaaaaacaaugauacuccc

SEQ ID NO: 3182 - RNA, 21 nt, artificial
  Oligomer
ugaucauucgccacucguucc

SEQ ID NO: 3183 - RNA, 21 nt, artificial
  Oligomer
guacaaaaacaaugauacucc

SEQ ID NO: 3184 - RNA, 21 nt, artificial
  Oligomer
auucgccacucguuccucucu

SEQ ID NO: 3185 - RNA, 21 nt, artificial
  Oligomer
aacuccacacagccaaucugc

SEQ ID NO: 3186 - RNA, 21 nt, artificial
  Oligomer
uuccagaagauaagcaacacc

SEQ ID NO: 3187 - RNA, 21 nt, artificial
  Oligomer
guguaggcgaauucaaugagg

SEQ ID NO: 3188 - RNA, 21 nt, artificial
  Oligomer
uguaggcgaauucaaugaggc

SEQ ID NO: 3189 - RNA, 21 nt, artificial
  Oligomer
auccaagaauaaaucacaugg

SEQ ID NO: 3190 - RNA, 21 nt, artificial
  Oligomer
uugcccaagaaacaaaagugc

SEQ ID NO: 3191 - RNA, 21 nt, artificial
  Oligomer
aagauaagcaacaccaccacc

SEQ ID NO: 3192 - RNA, 21 nt, artificial
  Oligomer
aaaguccacgucucuguuucc

SEQ ID NO: 3193 - RNA, 21 nt, artificial
  Oligomer
guaggcgaauucaaugaggcg

SEQ ID NO: 3194 - RNA, 21 nt, artificial
  Oligomer
ugcugucuuuucuuuuagucc

SEQ ID NO: 3195 - RNA, 21 nt, artificial
  Oligomer
cugucuuuucuuuuagucccg

SEQ ID NO: 3196 - RNA, 21 nt, artificial
  Oligomer
ugucuuuucuuuuagucccgg

SEQ ID NO: 3197 - RNA, 21 nt, artificial
  Oligomer
cauuggacuguauuuuugccc

SEQ ID NO: 3198 - RNA, 21 nt, artificial
  Oligomer
uacuugacccaguugaugcag

SEQ ID NO: 3199 - RNA, 21 nt, artificial
  Oligomer
uuuuagucccgguuuuuguac

SEQ ID NO: 3200 - RNA, 21 nt, artificial
  Oligomer
uucuauguacaggcccauccc

SEQ ID NO: 3201 - RNA, 21 nt, artificial
  Oligomer
uauuugcagugcugucuuuuc

SEQ ID NO: 3202 - RNA, 21 nt, artificial
  Oligomer
auuugcagugcugucuuuucu

SEQ ID NO: 3203 - RNA, 21 nt, artificial
  Oligomer
cccauuggacuguauuuuugc

SEQ ID NO: 3204 - RNA, 21 nt, artificial
  Oligomer
cacgucucuguuuccacaucg

SEQ ID NO: 3205 - RNA, 21 nt, artificial
  Oligomer
cucuguuuccacaucguagcg

SEQ ID NO: 3206 - RNA, 21 nt, artificial
  Oligomer
auagauacaguugugcaggac

SEQ ID NO: 3207 - RNA, 21 nt, artificial
  Oligomer
uuugcagugcugucuuuucuu

SEQ ID NO: 3208 - RNA, 21 nt, artificial
  Oligomer
cagugcugucuuuucuuuuag

SEQ ID NO: 3209 - RNA, 21 nt, artificial
  Oligomer
uuuuugcccaagaaacaaaag

SEQ ID NO: 3210 - RNA, 21 nt, artificial
  Oligomer
guuccagaagauaagcaacac

SEQ ID NO: 3211 - RNA, 21 nt, artificial
  Oligomer
cagguauccaagaauaaauca

SEQ ID NO: 3212 - RNA, 21 nt, artificial
  Oligomer
aaucacauggugacagcugcc

SEQ ID NO: 3213 - RNA, 21 nt, artificial
  Oligomer
gaagauaagcaacaccaccac

SEQ ID NO: 3214 - RNA, 21 nt, artificial
  Oligomer
auggguuauuugcagugcugu

SEQ ID NO: 3215 - RNA, 21 nt, artificial
  Oligomer
gugcugucuuuucuuuuaguc

SEQ ID NO: 3216 - RNA, 21 nt, artificial
  Oligomer
uccagaagauaagcaacacca

SEQ ID NO: 3217 - RNA, 21 nt, artificial
  Oligomer
uuacaggguuacuuaucaaca

SEQ ID NO: 3218 - RNA, 21 nt, artificial
  Oligomer
uugaagacagggcuggaugag

SEQ ID NO: 3219 - RNA, 21 nt, artificial
  Oligomer
gaagauggguuauuugcagug

SEQ ID NO: 3220 - RNA, 21 nt, artificial
  Oligomer
agauggguuauuugcagugcu

SEQ ID NO: 3221 - RNA, 21 nt, artificial
  Oligomer
gucuuuucuuuuagucccggu

SEQ ID NO: 3222 - RNA, 21 nt, artificial
  Oligomer
uucuuuuagucccgguuuuug

SEQ ID NO: 3223 - RNA, 21 nt, artificial
  Oligomer
uuugcccaagaaacaaaagug

SEQ ID NO: 3224 - RNA, 21 nt, artificial
  Oligomer
ugcccaagaaacaaaagugcc

SEQ ID NO: 3225 - RNA, 21 nt, artificial
  Oligomer
ucuguuuccacaucguagcgc

SEQ ID NO: 3226 - RNA, 21 nt, artificial
  Oligomer
uaacacucagcugaauuaagg

SEQ ID NO: 3227 - RNA, 21 nt, artificial
  Oligomer
auuacaggguuacuuaucaac

SEQ ID NO: 3228 - RNA, 21 nt, artificial
  Oligomer
uccaagaauaaaucacauggu

SEQ ID NO: 3229 - RNA, 21 nt, artificial
  Oligomer
ugagaugucauuuuaacacug

SEQ ID NO: 3230 - RNA, 21 nt, artificial
  Oligomer
gagaugucauuuuaacacuga

SEQ ID NO: 3231 - RNA, 21 nt, artificial
  Oligomer
uuucuuuuagucccgguuuuu

SEQ ID NO: 3232 - RNA, 21 nt, artificial
  Oligomer
cuguuuccacaucguagcgcu

SEQ ID NO: 3233 - RNA, 21 nt, artificial
  Oligomer
uguuuccacaucguagcgcuc

SEQ ID NO: 3234 - RNA, 21 nt, artificial
  Oligomer
aaaucacauggugacagcugc

SEQ ID NO: 3235 - RNA, 21 nt, artificial
  Oligomer
uuagucccgguuuuuguacaa

SEQ ID NO: 3236 - RNA, 21 nt, artificial
  Oligomer
ccauuggacuguauuuuugcc

SEQ ID NO: 3237 - RNA, 21 nt, artificial
  Oligomer
ucguaacacuccacacugucc

SEQ ID NO: 3238 - RNA, 21 nt, artificial
  Oligomer
auguagauguacucccgggca

SEQ ID NO: 3239 - RNA, 21 nt, artificial
  Oligomer
gaugucauuuuaacacugagg

SEQ ID NO: 3240 - RNA, 21 nt, artificial
  Oligomer
guaacacuccacacuguccag

SEQ ID NO: 3241 - RNA, 21 nt, artificial
  Oligomer
uaacacuccacacuguccagg

SEQ ID NO: 3242 - RNA, 21 nt, artificial
  Oligomer
aaguccacgucucuguuucca

SEQ ID NO: 3243 - RNA, 21 nt, artificial
  Oligomer
aguaacacucagcugaauuaa

SEQ ID NO: 3244 - RNA, 21 nt, artificial
  Oligomer
cauaaaggagacgauugagga

SEQ ID NO: 3245 - RNA, 21 nt, artificial
  Oligomer
auaaaggagacgauugaggac

SEQ ID NO: 3246 - RNA, 21 nt, artificial
  Oligomer
gauacccucaauggacaccac

SEQ ID NO: 3247 - RNA, 21 nt, artificial
  Oligomer
cuucuauguacaggcccaucc

SEQ ID NO: 3248 - RNA, 21 nt, artificial
  Oligomer
agaugucauuuuaacacugag

SEQ ID NO: 3249 - RNA, 21 nt, artificial
  Oligomer
aagaaacaaaagugccucaac

SEQ ID NO: 3250 - RNA, 21 nt, artificial
  Oligomer
ugaccaucauagccuccaagg

SEQ ID NO: 3251 - RNA, 21 nt, artificial
  Oligomer
aguccacgucucuguuuccac

SEQ ID NO: 3252 - RNA, 21 nt, artificial
  Oligomer
uccaggaacgugugaccauca

SEQ ID NO: 3253 - RNA, 21 nt, artificial
  Oligomer
augaugccaaaggccugcuug

SEQ ID NO: 3254 - RNA, 21 nt, artificial
  Oligomer
auuuuaacacugaggcauccu

SEQ ID NO: 3255 - RNA, 21 nt, artificial
  Oligomer
uuuaacacugaggcauccugg

SEQ ID NO: 3256 - RNA, 21 nt, artificial
  Oligomer
aaaugcauguagauguacucc

SEQ ID NO: 3257 - RNA, 21 nt, artificial
  Oligomer
ucuguucuuuauuuuccuugg

SEQ ID NO: 3258 - RNA, 21 nt, artificial
  Oligomer
auugcugugaucauucgccac

SEQ ID NO: 3259 - RNA, 21 nt, artificial
  Oligomer
aaggccugcuugguaugaucc

SEQ ID NO: 3260 - RNA, 21 nt, artificial
  Oligomer
caacaaaauaacuguccaucc

SEQ ID NO: 3261 - RNA, 21 nt, artificial
  Oligomer
acaaaauaacuguccauccgg

SEQ ID NO: 3262 - RNA, 21 nt, artificial
  Oligomer
augucauuuuaacacugaggc

SEQ ID NO: 3263 - RNA, 21 nt, artificial
  Oligomer
uuauuugcagugcugucuuuu

SEQ ID NO: 3264 - RNA, 21 nt, artificial
  Oligomer
uucauugcugugaucauucgc

SEQ ID NO: 3265 - RNA, 21 nt, artificial
  Oligomer
augacguggaggacacacuuc

SEQ ID NO: 3266 - RNA, 21 nt, artificial
  Oligomer
aacaaaauaacuguccauccg

SEQ ID NO: 3267 - RNA, 21 nt, artificial
  Oligomer
auccugguacuugaccugcag

SEQ ID NO: 3268 - RNA, 21 nt, artificial
  Oligomer
aauaaaucacauggugacagc

SEQ ID NO: 3269 - RNA, 21 nt, artificial
  Oligomer
cauuuuaacacugaggcaucc

SEQ ID NO: 3270 - RNA, 21 nt, artificial
  Oligomer
ucaugaugccaaaggccugcu

SEQ ID NO: 3271 - RNA, 21 nt, artificial
  Oligomer
cauugcugugaucauucgcca

SEQ ID NO: 3272 - RNA, 21 nt, artificial
  Oligomer
gucuguucuuuauuuuccuug

SEQ ID NO: 3273 - RNA, 21 nt, artificial
  Oligomer
cuguucuuuauuuuccuugga

SEQ ID NO: 3274 - RNA, 21 nt, artificial
  Oligomer
auaaaucacauggugacagcu

SEQ ID NO: 3275 - RNA, 21 nt, artificial
  Oligomer
cacucagcugaauuaaggcgg

SEQ ID NO: 3276 - RNA, 21 nt, artificial
  Oligomer
augauccuccaggguguagcu

SEQ ID NO: 3277 - RNA, 21 nt, artificial
  Oligomer
agguugaagaacuccucuugc

SEQ ID NO: 3278 - RNA, 21 nt, artificial
  Oligomer
gaucugguacaugacagcacc

SEQ ID NO: 3279 - RNA, 21 nt, artificial
  Oligomer
aucugguacaugacagcaccg

SEQ ID NO: 3280 - RNA, 21 nt, artificial
  Oligomer
auaagcaacaccaccaccucu

SEQ ID NO: 3281 - RNA, 21 nt, artificial
  Oligomer
auacccucaauggacaccacc

SEQ ID NO: 3282 - RNA, 21 nt, artificial
  Oligomer
gauaagcaacaccaccaccuc

SEQ ID NO: 3283 - RNA, 21 nt, artificial
  Oligomer
uuuccuuggaaaauuacaggg

SEQ ID NO: 3284 - RNA, 21 nt, artificial
  Oligomer
uuggaaaauuacaggguuacu

SEQ ID NO: 3285 - RNA, 21 nt, artificial
  Oligomer
aaagugccucaacagguacag

SEQ ID NO: 3286 - RNA, 21 nt, artificial
  Oligomer
aaaaugcauguagauguacuc

SEQ ID NO: 3287 - RNA, 21 nt, artificial
  Oligomer
ucgaucugguacaugacagca

SEQ ID NO: 3288 - RNA, 21 nt, artificial
  Oligomer
agggugaaagacacuaguuag

SEQ ID NO: 3289 - RNA, 21 nt, artificial
  Oligomer
aaauaacuguccauccggugg

SEQ ID NO: 3290 - RNA, 21 nt, artificial
  Oligomer
uuaacacugaggcauccuggc

SEQ ID NO: 3291 - RNA, 21 nt, artificial
  Oligomer
aagugccucaacagguacagu

SEQ ID NO: 3292 - RNA, 21 nt, artificial
  Oligomer
acucagcugaauuaaggcggu

SEQ ID NO: 3293 - RNA, 21 nt, artificial
  Oligomer
aaugcauguagauguacuccc

SEQ ID NO: 3294 - RNA, 21 nt, artificial
  Oligomer
gaaagacacuaguuagucugu

SEQ ID NO: 3295 - RNA, 21 nt, artificial
  Oligomer
aacauggccuugaagacaggg

SEQ ID NO: 3296 - RNA, 21 nt, artificial
  Oligomer
uuuuccuuggaaaauuacagg

SEQ ID NO: 3297 - RNA, 21 nt, artificial
  Oligomer
uaaaucacauggugacagcug

SEQ ID NO: 3298 - RNA, 21 nt, artificial
  Oligomer
aaaggccugcuugguaugauc

SEQ ID NO: 3299 - RNA, 21 nt, artificial
  Oligomer
aacacucagcugaauuaaggc

SEQ ID NO: 3300 - RNA, 21 nt, artificial
  Oligomer
uaccucuccacacuguugugg

SEQ ID NO: 3301 - RNA, 21 nt, artificial
  Oligomer
auagauguggccaucgaugac

SEQ ID NO: 3302 - RNA, 21 nt, artificial
  Oligomer
uagauguggccaucgaugacc

SEQ ID NO: 3303 - RNA, 21 nt, artificial
  Oligomer
auucccgcuuuggacuucuuu

SEQ ID NO: 3304 - RNA, 21 nt, artificial
  Oligomer
cucaacagguacaguucugcu

SEQ ID NO: 3305 - RNA, 21 nt, artificial
  Oligomer
uucaugaugccaaaggccugc

SEQ ID NO: 3306 - RNA, 21 nt, artificial
  Oligomer
uccaaggacguagauucuccc

SEQ ID NO: 3307 - RNA, 21 nt, artificial
  Oligomer
ucauugcugugaucauucgcc

SEQ ID NO: 3308 - RNA, 21 nt, artificial
  Oligomer
ugaauuaaggcgguuuguccc

SEQ ID NO: 3309 - RNA, 21 nt, artificial
  Oligomer
augcauguagauguacucccg

SEQ ID NO: 3310 - RNA, 21 nt, artificial
  Oligomer
uuccuuggaaaauuacagggu

SEQ ID NO: 3311 - RNA, 21 nt, artificial
  Oligomer
auuggacuguauuuuugccca

SEQ ID NO: 3312 - RNA, 21 nt, artificial
  Oligomer
caacagguacaguucugcugg

SEQ ID NO: 3313 - RNA, 21 nt, artificial
  Oligomer
auagccuccaaggacguagau

SEQ ID NO: 3314 - RNA, 21 nt, artificial
  Oligomer
agauacaguugugcaggacgc

SEQ ID NO: 3315 - RNA, 21 nt, artificial
  Oligomer
auuaaggcgguuugucccguc

SEQ ID NO: 3316 - RNA, 21 nt, artificial
  Oligomer
auccuucgugucagcauuggg

SEQ ID NO: 3317 - RNA, 21 nt, artificial
  Oligomer
auaccucuccacacuguugug

SEQ ID NO: 3318 - RNA, 21 nt, artificial
  Oligomer
aucuugaccagguaguccuug

SEQ ID NO: 3319 - RNA, 21 nt, artificial
  Oligomer
uucgcagucguacuugaccca

SEQ ID NO: 3320 - RNA, 21 nt, artificial
  Oligomer
uugaagaacuccucuugcuug

SEQ ID NO: 3321 - RNA, 21 nt, artificial
  Oligomer
uaggcgaauucaaugaggcgc

SEQ ID NO: 3322 - RNA, 21 nt, artificial
  Oligomer
uccgguggcuucuauguacag

SEQ ID NO: 3323 - RNA, 21 nt, artificial
  Oligomer
uuuggacuucuuuugagaugu

SEQ ID NO: 3324 - RNA, 21 nt, artificial
  Oligomer
aacagguacaguucugcuggu

SEQ ID NO: 3325 - RNA, 21 nt, artificial
  Oligomer
uacaguucugcuggucaaucu

SEQ ID NO: 3326 - RNA, 21 nt, artificial
  Oligomer
aucugggucguaacacuccac

SEQ ID NO: 3327 - RNA, 21 nt, artificial
  Oligomer
gaacgugugaccaucauagcc

SEQ ID NO: 3328 - RNA, 21 nt, artificial
  Oligomer
aacgugugaccaucauagccu

SEQ ID NO: 3329 - RNA, 21 nt, artificial
  Oligomer
acgugugaccaucauagccuc

SEQ ID NO: 3330 - RNA, 21 nt, artificial
  Oligomer
cuccaaggacguagauucucc

SEQ ID NO: 3331 - RNA, 21 nt, artificial
  Oligomer
uagauacaguugugcaggacg

SEQ ID NO: 3332 - RNA, 21 nt, artificial
  Oligomer
augguguucauugcugugauc

SEQ ID NO: 3333 - RNA, 21 nt, artificial
  Oligomer
uguucauugcugugaucauuc

SEQ ID NO: 3334 - RNA, 21 nt, artificial
  Oligomer
guucauugcugugaucauucg

SEQ ID NO: 3335 - RNA, 21 nt, artificial
  Oligomer
caaucugcucagcgaaguugg

SEQ ID NO: 3336 - RNA, 21 nt, artificial
  Oligomer
aagacacuaguuagucuguuc

SEQ ID NO: 3337 - RNA, 21 nt, artificial
  Oligomer
aauaacuguccauccgguggg

SEQ ID NO: 3338 - RNA, 21 nt, artificial
  Oligomer
aucccugggaaccacauuucc

SEQ ID NO: 3339 - RNA, 21 nt, artificial
  Oligomer
augauucccgcuuuggacuuc

SEQ ID NO: 3340 - RNA, 21 nt, artificial
  Oligomer
uuggacuucuuuugagauguc

SEQ ID NO: 3341 - RNA, 21 nt, artificial
  Oligomer
ucugcuggucaaucugcuucc

SEQ ID NO: 3342 - RNA, 21 nt, artificial
  Oligomer
gcagcauagauacaguugugc

SEQ ID NO: 3343 - RNA, 21 nt, artificial
  Oligomer
cucucuggguaguaacacuca

SEQ ID NO: 3344 - RNA, 21 nt, artificial
  Oligomer
gaauuaaggcgguuugucccg

SEQ ID NO: 3345 - RNA, 21 nt, artificial
  Oligomer
uuaaggcgguuugucccguca

SEQ ID NO: 3346 - RNA, 21 nt, artificial
  Oligomer
cuugguaugauccuccagggu

SEQ ID NO: 3347 - RNA, 21 nt, artificial
  Oligomer
aaaggagacgauugaggacag

SEQ ID NO: 3348 - RNA, 21 nt, artificial
  Oligomer
aaggagacgauugaggacagc

SEQ ID NO: 3349 - RNA, 21 nt, artificial
  Oligomer
uuguaagccuccagguagcug

SEQ ID NO: 3350 - RNA, 21 nt, artificial
  Oligomer
cagucguacuugacccaguug

SEQ ID NO: 3351 - RNA, 21 nt, artificial
  Oligomer
ugaagaacuccucuugcuugg

SEQ ID NO: 3352 - RNA, 21 nt, artificial
  Oligomer
ugaaagacacuaguuagucug

SEQ ID NO: 3353 - RNA, 21 nt, artificial
  Oligomer
aaacaaaagugccucaacagg

SEQ ID NO: 3354 - RNA, 21 nt, artificial
  Oligomer
ucguucaugaugccaaaggcc

SEQ ID NO: 3355 - RNA, 21 nt, artificial
  Oligomer
uccaggugucuguaucugggu

SEQ ID NO: 3356 - RNA, 21 nt, artificial
  Oligomer
uguaucugggucguaacacuc

SEQ ID NO: 3357 - RNA, 21 nt, artificial
  Oligomer
guaucugggucguaacacucc

SEQ ID NO: 3358 - RNA, 21 nt, artificial
  Oligomer
caucauagccuccaaggacgu

SEQ ID NO: 3359 - RNA, 21 nt, artificial
  Oligomer
agcagcauagauacaguugug

SEQ ID NO: 3360 - RNA, 21 nt, artificial
  Oligomer
acacucagcugaauuaaggcg

SEQ ID NO: 3361 - RNA, 21 nt, artificial
  Oligomer
aauuaaggcgguuugucccgu

SEQ ID NO: 3362 - RNA, 21 nt, artificial
  Oligomer
guuguaagccuccagguagcu

SEQ ID NO: 3363 - RNA, 21 nt, artificial
  Oligomer
ucuugaccagguaguccuugc

SEQ ID NO: 3364 - RNA, 21 nt, artificial
  Oligomer
uugaccagguaguccuugcag

SEQ ID NO: 3365 - RNA, 21 nt, artificial
  Oligomer
ugcauguagauguacucccgg

SEQ ID NO: 3366 - RNA, 21 nt, artificial
  Oligomer
aaucugcucagcgaaguuggc

SEQ ID NO: 3367 - RNA, 21 nt, artificial
  Oligomer
gucgaucugguacaugacagc

SEQ ID NO: 3368 - RNA, 21 nt, artificial
  Oligomer
gaacauggccuugaagacagg

SEQ ID NO: 3369 - RNA, 21 nt, artificial
  Oligomer
agacacuaguuagucuguucu

SEQ ID NO: 3370 - RNA, 21 nt, artificial
  Oligomer
ugcauccugguacuugaccug

SEQ ID NO: 3371 - RNA, 21 nt, artificial
  Oligomer
uuuuaacacugaggcauccug

SEQ ID NO: 3372 - RNA, 21 nt, artificial
  Oligomer
uuggacuguauuuuugcccaa

SEQ ID NO: 3373 - RNA, 21 nt, artificial
  Oligomer
caaaagugccucaacagguac

SEQ ID NO: 3374 - RNA, 21 nt, artificial
  Oligomer
gugccucaacagguacaguuc

SEQ ID NO: 3375 - RNA, 21 nt, artificial
  Oligomer
ccucaacagguacaguucugc

SEQ ID NO: 3376 - RNA, 21 nt, artificial
  Oligomer
cagcauagauacaguugugca

SEQ ID NO: 3377 - RNA, 21 nt, artificial
  Oligomer
cuucggaugguguucauugcu

SEQ ID NO: 3378 - RNA, 21 nt, artificial
  Oligomer
uuccucucuggguaguaacac

SEQ ID NO: 3379 - RNA, 21 nt, artificial
  Oligomer
cucuggguaguaacacucagc

SEQ ID NO: 3380 - RNA, 21 nt, artificial
  Oligomer
cugcuugguaugauccuccag

SEQ ID NO: 3381 - RNA, 21 nt, artificial
  Oligomer
agcugaauuaaggcgguuugu

SEQ ID NO: 3382 - RNA, 21 nt, artificial
  Oligomer
cuguucgcagucguacuugac

SEQ ID NO: 3383 - RNA, 21 nt, artificial
  Oligomer
gacagguugaagaacuccucu

SEQ ID NO: 3384 - RNA, 21 nt, artificial
  Oligomer
uucaugacguggaggacacac

SEQ ID NO: 3385 - RNA, 21 nt, artificial
  Oligomer
guggauacccucaauggacac

SEQ ID NO: 3386 - RNA, 21 nt, artificial
  Oligomer
gugaaagacacuaguuagucu

SEQ ID NO: 3387 - RNA, 21 nt, artificial
  Oligomer
caagaauaaaucacaugguga

SEQ ID NO: 3388 - RNA, 21 nt, artificial
  Oligomer
caguucugcuggucaaucugc

SEQ ID NO: 3389 - RNA, 21 nt, artificial
  Oligomer
uucugcuggucaaucugcuuc

SEQ ID NO: 3390 - RNA, 21 nt, artificial
  Oligomer
ucgcuccaggugucuguaucu

SEQ ID NO: 3391 - RNA, 21 nt, artificial
  Oligomer
uaucugggucguaacacucca

SEQ ID NO: 3392 - RNA, 21 nt, artificial
  Oligomer
gauacaguugugcaggacgca

SEQ ID NO: 3393 - RNA, 21 nt, artificial
  Oligomer
auacaguugugcaggacgcag

SEQ ID NO: 3394 - RNA, 21 nt, artificial
  Oligomer
uucggaugguguucauugcug

SEQ ID NO: 3395 - RNA, 21 nt, artificial
  Oligomer
cugaauuaaggcgguuugucc

SEQ ID NO: 3396 - RNA, 21 nt, artificial
  Oligomer
accucuccacacuguuguggu

SEQ ID NO: 3397 - RNA, 21 nt, artificial
  Oligomer
ugggacagguugaagaacucc

SEQ ID NO: 3398 - RNA, 21 nt, artificial
  Oligomer
gaagaacuccucuugcuuggc

SEQ ID NO: 3399 - RNA, 21 nt, artificial
  Oligomer
aagaacuccucuugcuuggcc

SEQ ID NO: 3400 - RNA, 21 nt, artificial
  Oligomer
ccaaaaugcauguagauguac

SEQ ID NO: 3401 - RNA, 21 nt, artificial
  Oligomer
auccgguggcuucuauguaca

SEQ ID NO: 3402 - RNA, 21 nt, artificial
  Oligomer
caucccugggaaccacauuuc

SEQ ID NO: 3403 - RNA, 21 nt, artificial
  Oligomer
ugauucccgcuuuggacuucu

SEQ ID NO: 3404 - RNA, 21 nt, artificial
  Oligomer
cugguacuugaccugcagugu

SEQ ID NO: 3405 - RNA, 21 nt, artificial
  Oligomer
uggacuucuuuugagauguca

SEQ ID NO: 3406 - RNA, 21 nt, artificial
  Oligomer
gaaacaaaagugccucaacag

SEQ ID NO: 3407 - RNA, 21 nt, artificial
  Oligomer
cucguucaugaugccaaaggc

SEQ ID NO: 3408 - RNA, 21 nt, artificial
  Oligomer
aacacuccacacuguccagga

SEQ ID NO: 3409 - RNA, 21 nt, artificial
  Oligomer
gcauagauacaguugugcagg

SEQ ID NO: 3410 - RNA, 21 nt, artificial
  Oligomer
ugguguucauugcugugauca

SEQ ID NO: 3411 - RNA, 21 nt, artificial
  Oligomer
ucuggguaguaacacucagcu

SEQ ID NO: 3412 - RNA, 21 nt, artificial
  Oligomer
cuggguaguaacacucagcug

SEQ ID NO: 3413 - RNA, 21 nt, artificial
  Oligomer
cagguugaagaacuccucuug

SEQ ID NO: 3414 - RNA, 21 nt, artificial
  Oligomer
acaugacagcaccguucauga

SEQ ID NO: 3415 - RNA, 21 nt, artificial
  Oligomer
augacagcaccguucaugacg

SEQ ID NO: 3416 - RNA, 21 nt, artificial
  Oligomer
agaauaaaucacauggugaca

SEQ ID NO: 3417 - RNA, 21 nt, artificial
  Oligomer
uacuugaccugcagugugacg

SEQ ID NO: 3418 - RNA, 21 nt, artificial
  Oligomer
acaguucugcuggucaaucug

SEQ ID NO: 3419 - RNA, 21 nt, artificial
  Oligomer
gauccuucgugucagcauugg

SEQ ID NO: 3420 - RNA, 21 nt, artificial
  Oligomer
auucaaugaggcgcuccauga

SEQ ID NO: 3421 - RNA, 21 nt, artificial
  Oligomer
aagaauaaaucacauggugac

SEQ ID NO: 3422 - RNA, 21 nt, artificial
  Oligomer
uugaccugcagugugacguca

SEQ ID NO: 3423 - RNA, 21 nt, artificial
  Oligomer
aacaaaagugccucaacaggu

SEQ ID NO: 3424 - RNA, 21 nt, artificial
  Oligomer
uucaaugaggcgcuccaugac

SEQ ID NO: 3425 - RNA, 21 nt, artificial
  Oligomer
aaugaggcgcuccaugaccuu

SEQ ID NO: 3426 - RNA, 21 nt, artificial
  Oligomer
ugggaaccacauuuccagagg

SEQ ID NO: 3427 - RNA, 21 nt, artificial
  Oligomer
uucccggaagauggguuauuu

SEQ ID NO: 3428 - RNA, 21 nt, artificial
  Oligomer
ucggaugguguucauugcugu

SEQ ID NO: 3429 - RNA, 21 nt, artificial
  Oligomer
uuggugaacauggccuugaag

SEQ ID NO: 3430 - RNA, 21 nt, artificial
  Oligomer
guacuugaccugcagugugac

SEQ ID NO: 3431 - RNA, 21 nt, artificial
  Oligomer
uacgaaaguccacgucucugu

SEQ ID NO: 3432 - RNA, 21 nt, artificial
  Oligomer
aaaauaacuguccauccggug

SEQ ID NO: 3433 - RNA, 21 nt, artificial
  Oligomer
ucccggaagauggguuauuug

SEQ ID NO: 3434 - RNA, 21 nt, artificial
  Oligomer
ugucauuuuaacacugaggca

SEQ ID NO: 3435 - RNA, 21 nt, artificial
  Oligomer
uucagcugguccugaccauca

SEQ ID NO: 3436 - RNA, 19 nt, artificial
  Oligomer
accugaaauuugcuggaau

SEQ ID NO: 3437 - RNA, 19 nt, artificial
  Oligomer
cgaguaugucgccuauguu

SEQ ID NO: 3438 - RNA, 19 nt, artificial
  Oligomer
cagagagcuuuuugaugau

SEQ ID NO: 3439 - RNA, 19 nt, artificial
  Oligomer
gcagagagcuuuuugauga

SEQ ID NO: 3440 - RNA, 19 nt, artificial
  Oligomer
ccgcuuugaaagugucagu

SEQ ID NO: 3441 - RNA, 19 nt, artificial
  Oligomer
agcuuuuugaugaucccuc

SEQ ID NO: 3442 - RNA, 19 nt, artificial
  Oligomer
ugaccaucaguacuauaau

SEQ ID NO: 3443 - RNA, 19 nt, artificial
  Oligomer
cacaugcaaucuaucucau

SEQ ID NO: 3444 - RNA, 19 nt, artificial
  Oligomer
ccuacuugguucgguacau

SEQ ID NO: 3445 - RNA, 19 nt, artificial
  Oligomer
ccuaugucaacguccagaa

SEQ ID NO: 3446 - RNA, 19 nt, artificial
  Oligomer
agagagcuuuuugaugauc

SEQ ID NO: 3447 - RNA, 19 nt, artificial
  Oligomer
agagcuuuuugaugauccc

SEQ ID NO: 3448 - RNA, 19 nt, artificial
  Oligomer
ucaaacaauaccucaggaa

SEQ ID NO: 3449 - RNA, 19 nt, artificial
  Oligomer
acaugcaaucuaucucauu

SEQ ID NO: 3450 - RNA, 19 nt, artificial
  Oligomer
aaccugaaauuugcuggaa

SEQ ID NO: 3451 - RNA, 19 nt, artificial
  Oligomer
cgcuuugaaagugucaguc

SEQ ID NO: 3452 - RNA, 19 nt, artificial
  Oligomer
gggaccuguuugacaugaa

SEQ ID NO: 3453 - RNA, 19 nt, artificial
  Oligomer
ccuccuaugucaacgucca

SEQ ID NO: 3454 - RNA, 19 nt, artificial
  Oligomer
ucccuccuaugucaacguc

SEQ ID NO: 3455 - RNA, 19 nt, artificial
  Oligomer
guacuauaaugacuucccg

SEQ ID NO: 3456 - RNA, 19 nt, artificial
  Oligomer
agggugugguucggacuaa

SEQ ID NO: 3457 - RNA, 19 nt, artificial
  Oligomer
agacaugaggcuucgggaa

SEQ ID NO: 3458 - RNA, 19 nt, artificial
  Oligomer
gcgcuucaaacaauaccuc

SEQ ID NO: 3459 - RNA, 19 nt, artificial
  Oligomer
ccaaucacucucaccgucu

SEQ ID NO: 3460 - RNA, 19 nt, artificial
  Oligomer
gcauuugcuacugguggac

SEQ ID NO: 3461 - RNA, 19 nt, artificial
  Oligomer
gugguagacaugaggcuuc

SEQ ID NO: 3462 - RNA, 19 nt, artificial
  Oligomer
caaucacucucaccgucuc

SEQ ID NO: 3463 - RNA, 19 nt, artificial
  Oligomer
cgggagcuuugucaauaag

SEQ ID NO: 3464 - RNA, 19 nt, artificial
  Oligomer
ggacaugaacaagcugagu

SEQ ID NO: 3465 - RNA, 19 nt, artificial
  Oligomer
cccaauccugcuaucaaug

SEQ ID NO: 3466 - RNA, 19 nt, artificial
  Oligomer
cgaguugcgcuucaaacaa

SEQ ID NO: 3467 - RNA, 19 nt, artificial
  Oligomer
gcuuugaaagugucaguca

SEQ ID NO: 3468 - RNA, 19 nt, artificial
  Oligomer
ugauggcucagcaugggau

SEQ ID NO: 3469 - RNA, 19 nt, artificial
  Oligomer
ugcgcuucaaacaauaccu

SEQ ID NO: 3470 - RNA, 19 nt, artificial
  Oligomer
augcaaucuaucucauuug

SEQ ID NO: 3471 - RNA, 19 nt, artificial
  Oligomer
accacaugcaaucuaucuc

SEQ ID NO: 3472 - RNA, 19 nt, artificial
  Oligomer
ccaccacaugcaaucuauc

SEQ ID NO: 3473 - RNA, 19 nt, artificial
  Oligomer
guacauggguuguguggag

SEQ ID NO: 3474 - RNA, 19 nt, artificial
  Oligomer
ggaucaccgcuuugaaagu

SEQ ID NO: 3475 - RNA, 19 nt, artificial
  Oligomer
gguucggacuaaggaucac

SEQ ID NO: 3476 - RNA, 19 nt, artificial
  Oligomer
cgggaccuguuugacauga

SEQ ID NO: 3477 - RNA, 19 nt, artificial
  Oligomer
cgcuucaaacaauaccuca

SEQ ID NO: 3478 - RNA, 19 nt, artificial
  Oligomer
gacaugaacaagcugagug

SEQ ID NO: 3479 - RNA, 19 nt, artificial
  Oligomer
gcuucaaacaauaccucag

SEQ ID NO: 3480 - RNA, 19 nt, artificial
  Oligomer
aguugcgcuucaaacaaua

SEQ ID NO: 3481 - RNA, 19 nt, artificial
  Oligomer
agcuaccacauggacaauc

SEQ ID NO: 3482 - RNA, 19 nt, artificial
  Oligomer
cagcuaccacauggacaau

SEQ ID NO: 3483 - RNA, 19 nt, artificial
  Oligomer
accuuaucagcuaccacau

SEQ ID NO: 3484 - RNA, 19 nt, artificial
  Oligomer
ggacuaaggaucaccgcuu

SEQ ID NO: 3485 - RNA, 19 nt, artificial
  Oligomer
ugggcagccuaagcauuug

SEQ ID NO: 3486 - RNA, 19 nt, artificial
  Oligomer
cgaacugugucuacagcaa

SEQ ID NO: 3487 - RNA, 19 nt, artificial
  Oligomer
gugucagucaccuuaucag

SEQ ID NO: 3488 - RNA, 19 nt, artificial
  Oligomer
gggaggaguaaccugaaau

SEQ ID NO: 3489 - RNA, 19 nt, artificial
  Oligomer
gccuaagcauuugcuacug

SEQ ID NO: 3490 - RNA, 19 nt, artificial
  Oligomer
acaaucacuugcccaucau

SEQ ID NO: 3491 - RNA, 19 nt, artificial
  Oligomer
agauccagaaguccgcaaa

SEQ ID NO: 3492 - RNA, 19 nt, artificial
  Oligomer
ccaucaguacuauaaugac

SEQ ID NO: 3493 - RNA, 19 nt, artificial
  Oligomer
agccaccugaccaucagua

SEQ ID NO: 3494 - RNA, 19 nt, artificial
  Oligomer
agccgaguaugucgccuau

SEQ ID NO: 3495 - RNA, 19 nt, artificial
  Oligomer
aggaggagaaagcccugua

SEQ ID NO: 3496 - RNA, 19 nt, artificial
  Oligomer
ucagcuaccacauggacaa

SEQ ID NO: 3497 - RNA, 19 nt, artificial
  Oligomer
gggagcuacauugccugua

SEQ ID NO: 3498 - RNA, 19 nt, artificial
  Oligomer
cugaccaucaguacuauaa

SEQ ID NO: 3499 - RNA, 19 nt, artificial
  Oligomer
gaaauuugcuggaaugcca

SEQ ID NO: 3500 - RNA, 19 nt, artificial
  Oligomer
acguccagaaccuagacaa

SEQ ID NO: 3501 - RNA, 19 nt, artificial
  Oligomer
accaucaguacuauaauga

SEQ ID NO: 3502 - RNA, 19 nt, artificial
  Oligomer
gcaaacagaucaucgccaa

SEQ ID NO: 3503 - RNA, 19 nt, artificial
  Oligomer
cagacugcaaacagaucau

SEQ ID NO: 3504 - RNA, 19 nt, artificial
  Oligomer
accacauggacaaucacuu

SEQ ID NO: 3505 - RNA, 19 nt, artificial
  Oligomer
cuaagcauuugcuacuggu

SEQ ID NO: 3506 - RNA, 19 nt, artificial
  Oligomer
gagauccagaaguccgcaa

SEQ ID NO: 3507 - RNA, 19 nt, artificial
  Oligomer
cgccuauguugccaaagac

SEQ ID NO: 3508 - RNA, 19 nt, artificial
  Oligomer
uggacaaucacuugcccau

SEQ ID NO: 3509 - RNA, 19 nt, artificial
  Oligomer
aggcagagagcuuuuugau

SEQ ID NO: 3510 - RNA, 19 nt, artificial
  Oligomer
ccugaccaucaguacuaua

SEQ ID NO: 3511 - RNA, 19 nt, artificial
  Oligomer
ccgcagacugcaaacagau

SEQ ID NO: 3512 - RNA, 19 nt, artificial
  Oligomer
ggguuuccuacuugguucg

SEQ ID NO: 3513 - RNA, 19 nt, artificial
  Oligomer
ggacaaucacuugcccauc

SEQ ID NO: 3514 - RNA, 19 nt, artificial
  Oligomer
gcagccuaagcauuugcua

SEQ ID NO: 3515 - RNA, 19 nt, artificial
  Oligomer
caggcagagagcuuuuuga

SEQ ID NO: 3516 - RNA, 19 nt, artificial
  Oligomer
ggagcuacauugccuguag

SEQ ID NO: 3517 - RNA, 19 nt, artificial
  Oligomer
gcaaucuaucucauuugca

SEQ ID NO: 3518 - RNA, 19 nt, artificial
  Oligomer
ugcaucccaacgacaaagu

SEQ ID NO: 3519 - RNA, 19 nt, artificial
  Oligomer
gaaugccaaucacucucac

SEQ ID NO: 3520 - RNA, 19 nt, artificial
  Oligomer
caacgacaaagucauggga

SEQ ID NO: 3521 - RNA, 19 nt, artificial
  Oligomer
agccuaagcauuugcuacu

SEQ ID NO: 3522 - RNA, 19 nt, artificial
  Oligomer
ggcagccuaagcauuugcu

SEQ ID NO: 3523 - RNA, 19 nt, artificial
  Oligomer
accugaccaucaguacuau

SEQ ID NO: 3524 - RNA, 19 nt, artificial
  Oligomer
caccugaccaucaguacua

SEQ ID NO: 3525 - RNA, 19 nt, artificial
  Oligomer
ggcuuugauggcucagcau

SEQ ID NO: 3526 - RNA, 19 nt, artificial
  Oligomer
accaccacaugcaaucuau

SEQ ID NO: 3527 - RNA, 19 nt, artificial
  Oligomer
gcagacugcaaacagauca

SEQ ID NO: 3528 - RNA, 19 nt, artificial
  Oligomer
ugaaagugucagucaccuu

SEQ ID NO: 3529 - RNA, 19 nt, artificial
  Oligomer
ggcagagagcuuuuugaug

SEQ ID NO: 3530 - RNA, 19 nt, artificial
  Oligomer
gccacuugggagcuacauu

SEQ ID NO: 3531 - RNA, 19 nt, artificial
  Oligomer
ugucgccuauguugccaaa

SEQ ID NO: 3532 - RNA, 19 nt, artificial
  Oligomer
uggagguccuccagucaau

SEQ ID NO: 3533 - RNA, 19 nt, artificial
  Oligomer
gucaccuuaucagcuacca

SEQ ID NO: 3534 - RNA, 19 nt, artificial
  Oligomer
ucaccgcuuugaaaguguc

SEQ ID NO: 3535 - RNA, 19 nt, artificial
  Oligomer
ccuaagcauuugcuacugg

SEQ ID NO: 3536 - RNA, 19 nt, artificial
  Oligomer
gcccuucgaagaugcucuu

SEQ ID NO: 3537 - RNA, 19 nt, artificial
  Oligomer
ugcuaucaauggcagugca

SEQ ID NO: 3538 - RNA, 19 nt, artificial
  Oligomer
ugacaggauggcuggcuuu

SEQ ID NO: 3539 - RNA, 19 nt, artificial
  Oligomer
ccuucgaguugcgcuucaa

SEQ ID NO: 3540 - RNA, 19 nt, artificial
  Oligomer
uugccaaagacccugugaa

SEQ ID NO: 3541 - RNA, 19 nt, artificial
  Oligomer
ugcaaucuaucucauuugc

SEQ ID NO: 3542 - RNA, 19 nt, artificial
  Oligomer
gcgaacugugucuacagca

SEQ ID NO: 3543 - RNA, 19 nt, artificial
  Oligomer
aguaugugcucacuggcuu

SEQ ID NO: 3544 - RNA, 19 nt, artificial
  Oligomer
uggcuuugauggcucagca

SEQ ID NO: 3545 - RNA, 19 nt, artificial
  Oligomer
agacugcaaacagaucauc

SEQ ID NO: 3546 - RNA, 19 nt, artificial
  Oligomer
gcaucccaacgacaaaguc

SEQ ID NO: 3547 - RNA, 19 nt, artificial
  Oligomer
gcugcaucccaacgacaaa

SEQ ID NO: 3548 - RNA, 19 nt, artificial
  Oligomer
agcauuugcuacuggugga

SEQ ID NO: 3549 - RNA, 19 nt, artificial
  Oligomer
ucaacguccagaaccuaga

SEQ ID NO: 3550 - RNA, 19 nt, artificial
  Oligomer
ugccaaagacccugugaau

SEQ ID NO: 3551 - RNA, 19 nt, artificial
  Oligomer
ccaaccaccacaugcaauc

SEQ ID NO: 3552 - RNA, 19 nt, artificial
  Oligomer
ugcaaacagaucaucgcca

SEQ ID NO: 3553 - RNA, 19 nt, artificial
  Oligomer
ccaacgacaaagucauggg

SEQ ID NO: 3554 - RNA, 19 nt, artificial
  Oligomer
ggagcuuugucaauaagcc

SEQ ID NO: 3555 - RNA, 19 nt, artificial
  Oligomer
ccugcuaucaauggcagug

SEQ ID NO: 3556 - RNA, 19 nt, artificial
  Oligomer
agccacuugggagcuacau

SEQ ID NO: 3557 - RNA, 19 nt, artificial
  Oligomer
ccaccugaccaucaguacu

SEQ ID NO: 3558 - RNA, 19 nt, artificial
  Oligomer
gccaaagacccugugaauc

SEQ ID NO: 3559 - RNA, 19 nt, artificial
  Oligomer
aaccaccacaugcaaucua

SEQ ID NO: 3560 - RNA, 19 nt, artificial
  Oligomer
gcuuugucaauaagcccac

SEQ ID NO: 3561 - RNA, 19 nt, artificial
  Oligomer
cagucaccuuaucagcuac

SEQ ID NO: 3562 - RNA, 19 nt, artificial
  Oligomer
ugacaugaagcccuucgaa

SEQ ID NO: 3563 - RNA, 19 nt, artificial
  Oligomer
cugccacauucuggagugu

SEQ ID NO: 3564 - RNA, 19 nt, artificial
  Oligomer
gccaaccaccacaugcaau

SEQ ID NO: 3565 - RNA, 19 nt, artificial
  Oligomer
cgcagacugcaaacagauc

SEQ ID NO: 3566 - RNA, 19 nt, artificial
  Oligomer
caccuuaucagcuaccaca

SEQ ID NO: 3567 - RNA, 19 nt, artificial
  Oligomer
caggaugucaucagcacca

SEQ ID NO: 3568 - RNA, 19 nt, artificial
  Oligomer
uggccaguaugugcucacu

SEQ ID NO: 3569 - RNA, 19 nt, artificial
  Oligomer
aggaugucaucagcaccau

SEQ ID NO: 3570 - RNA, 19 nt, artificial
  Oligomer
cccuucgaagaugcucuuc

SEQ ID NO: 3571 - RNA, 19 nt, artificial
  Oligomer
uguuugacaugaagcccuu

SEQ ID NO: 3572 - RNA, 19 nt, artificial
  Oligomer
cuguuugacaugaagcccu

SEQ ID NO: 3573 - RNA, 19 nt, artificial
  Oligomer
ggaugucaucagcaccauu

SEQ ID NO: 3574 - RNA, 19 nt, artificial
  Oligomer
ucaucgccaaccaccacau

SEQ ID NO: 3575 - RNA, 19 nt, artificial
  Oligomer
ggguucuuauaauggaaaa

SEQ ID NO: 3576 - RNA, 19 nt, artificial
  Oligomer
cccaagcccaaguacaauc

SEQ ID NO: 3577 - RNA, 19 nt, artificial
  Oligomer
aggaagggcagcugaugau

SEQ ID NO: 3578 - RNA, 19 nt, artificial
  Oligomer
auuccagcaaauuucaggu

SEQ ID NO: 3579 - RNA, 19 nt, artificial
  Oligomer
aacauaggcgacauacucg

SEQ ID NO: 3580 - RNA, 19 nt, artificial
  Oligomer
aucaucaaaaagcucucug

SEQ ID NO: 3581 - RNA, 19 nt, artificial
  Oligomer
ucaucaaaaagcucucugc

SEQ ID NO: 3582 - RNA, 19 nt, artificial
  Oligomer
acugacacuuucaaagcgg

SEQ ID NO: 3583 - RNA, 19 nt, artificial
  Oligomer
gagggaucaucaaaaagcu

SEQ ID NO: 3584 - RNA, 19 nt, artificial
  Oligomer
auuauaguacugaugguca

SEQ ID NO: 3585 - RNA, 19 nt, artificial
  Oligomer
augagauagauugcaugug

SEQ ID NO: 3586 - RNA, 19 nt, artificial
  Oligomer
auguaccgaaccaaguagg

SEQ ID NO: 3587 - RNA, 19 nt, artificial
  Oligomer
uucuggacguugacauagg

SEQ ID NO: 3588 - RNA, 19 nt, artificial
  Oligomer
gaucaucaaaaagcucucu

SEQ ID NO: 3589 - RNA, 19 nt, artificial
  Oligomer
gggaucaucaaaaagcucu

SEQ ID NO: 3590 - RNA, 19 nt, artificial
  Oligomer
uuccugagguauuguuuga

SEQ ID NO: 3591 - RNA, 19 nt, artificial
  Oligomer
aaugagauagauugcaugu

SEQ ID NO: 3592 - RNA, 19 nt, artificial
  Oligomer
uuccagcaaauuucagguu

SEQ ID NO: 3593 - RNA, 19 nt, artificial
  Oligomer
gacugacacuuucaaagcg

SEQ ID NO: 3594 - RNA, 19 nt, artificial
  Oligomer
uucaugucaaacagguccc

SEQ ID NO: 3595 - RNA, 19 nt, artificial
  Oligomer
uggacguugacauaggagg

SEQ ID NO: 3596 - RNA, 19 nt, artificial
  Oligomer
gacguugacauaggaggga

SEQ ID NO: 3597 - RNA, 19 nt, artificial
  Oligomer
cgggaagucauuauaguac

SEQ ID NO: 3598 - RNA, 19 nt, artificial
  Oligomer
uuaguccgaaccacacccu

SEQ ID NO: 3599 - RNA, 19 nt, artificial
  Oligomer
uucccgaagccucaugucu

SEQ ID NO: 3600 - RNA, 19 nt, artificial
  Oligomer
gagguauuguuugaagcgc

SEQ ID NO: 3601 - RNA, 19 nt, artificial
  Oligomer
agacggugagagugauugg

SEQ ID NO: 3602 - RNA, 19 nt, artificial
  Oligomer
guccaccaguagcaaaugc

SEQ ID NO: 3603 - RNA, 19 nt, artificial
  Oligomer
gaagccucaugucuaccac

SEQ ID NO: 3604 - RNA, 19 nt, artificial
  Oligomer
gagacggugagagugauug

SEQ ID NO: 3605 - RNA, 19 nt, artificial
  Oligomer
cuuauugacaaagcucccg

SEQ ID NO: 3606 - RNA, 19 nt, artificial
  Oligomer
acucagcuuguucaugucc

SEQ ID NO: 3607 - RNA, 19 nt, artificial
  Oligomer
cauugauagcaggauuggg

SEQ ID NO: 3608 - RNA, 19 nt, artificial
  Oligomer
uuguuugaagcgcaacucg

SEQ ID NO: 3609 - RNA, 19 nt, artificial
  Oligomer
ugacugacacuuucaaagc

SEQ ID NO: 3610 - RNA, 19 nt, artificial
  Oligomer
aucccaugcugagccauca

SEQ ID NO: 3611 - RNA, 19 nt, artificial
  Oligomer
agguauuguuugaagcgca

SEQ ID NO: 3612 - RNA, 19 nt, artificial
  Oligomer
caaaugagauagauugcau

SEQ ID NO: 3613 - RNA, 19 nt, artificial
  Oligomer
gagauagauugcauguggu

SEQ ID NO: 3614 - RNA, 19 nt, artificial
  Oligomer
gauagauugcauguggugg

SEQ ID NO: 3615 - RNA, 19 nt, artificial
  Oligomer
cuccacacaacccauguac

SEQ ID NO: 3616 - RNA, 19 nt, artificial
  Oligomer
acuuucaaagcggugaucc

SEQ ID NO: 3617 - RNA, 19 nt, artificial
  Oligomer
gugauccuuaguccgaacc

SEQ ID NO: 3618 - RNA, 19 nt, artificial
  Oligomer
ucaugucaaacaggucccg

SEQ ID NO: 3619 - RNA, 19 nt, artificial
  Oligomer
ugagguauuguuugaagcg

SEQ ID NO: 3620 - RNA, 19 nt, artificial
  Oligomer
cacucagcuuguucauguc

SEQ ID NO: 3621 - RNA, 19 nt, artificial
  Oligomer
cugagguauuguuugaagc

SEQ ID NO: 3622 - RNA, 19 nt, artificial
  Oligomer
uauuguuugaagcgcaacu

SEQ ID NO: 3623 - RNA, 19 nt, artificial
  Oligomer
gauuguccaugugguagcu

SEQ ID NO: 3624 - RNA, 19 nt, artificial
  Oligomer
auuguccaugugguagcug

SEQ ID NO: 3625 - RNA, 19 nt, artificial
  Oligomer
augugguagcugauaaggu

SEQ ID NO: 3626 - RNA, 19 nt, artificial
  Oligomer
aagcggugauccuuagucc

SEQ ID NO: 3627 - RNA, 19 nt, artificial
  Oligomer
caaaugcuuaggcugccca

SEQ ID NO: 3628 - RNA, 19 nt, artificial
  Oligomer
uugcuguagacacaguucg

SEQ ID NO: 3629 - RNA, 19 nt, artificial
  Oligomer
cugauaaggugacugacac

SEQ ID NO: 3630 - RNA, 19 nt, artificial
  Oligomer
auuucagguuacuccuccc

SEQ ID NO: 3631 - RNA, 19 nt, artificial
  Oligomer
caguagcaaaugcuuaggc

SEQ ID NO: 3632 - RNA, 19 nt, artificial
  Oligomer
augaugggcaagugauugu

SEQ ID NO: 3633 - RNA, 19 nt, artificial
  Oligomer
uuugcggacuucuggaucu

SEQ ID NO: 3634 - RNA, 19 nt, artificial
  Oligomer
gucauuauaguacugaugg

SEQ ID NO: 3635 - RNA, 19 nt, artificial
  Oligomer
uacugauggucagguggcu

SEQ ID NO: 3636 - RNA, 19 nt, artificial
  Oligomer
auaggcgacauacucggcu

SEQ ID NO: 3637 - RNA, 19 nt, artificial
  Oligomer
uacagggcuuucuccuccu

SEQ ID NO: 3638 - RNA, 19 nt, artificial
  Oligomer
uuguccaugugguagcuga

SEQ ID NO: 3639 - RNA, 19 nt, artificial
  Oligomer
uacaggcaauguagcuccc

SEQ ID NO: 3640 - RNA, 19 nt, artificial
  Oligomer
uuauaguacugauggucag

SEQ ID NO: 3641 - RNA, 19 nt, artificial
  Oligomer
uggcauuccagcaaauuuc

SEQ ID NO: 3642 - RNA, 19 nt, artificial
  Oligomer
uugucuagguucuggacgu

SEQ ID NO: 3643 - RNA, 19 nt, artificial
  Oligomer
ucauuauaguacugauggu

SEQ ID NO: 3644 - RNA, 19 nt, artificial
  Oligomer
uuggcgaugaucuguuugc

SEQ ID NO: 3645 - RNA, 19 nt, artificial
  Oligomer
augaucuguuugcagucug

SEQ ID NO: 3646 - RNA, 19 nt, artificial
  Oligomer
aagugauuguccauguggu

SEQ ID NO: 3647 - RNA, 19 nt, artificial
  Oligomer
accaguagcaaaugcuuag

SEQ ID NO: 3648 - RNA, 19 nt, artificial
  Oligomer
uugcggacuucuggaucuc

SEQ ID NO: 3649 - RNA, 19 nt, artificial
  Oligomer
gucuuuggcaacauaggcg

SEQ ID NO: 3650 - RNA, 19 nt, artificial
  Oligomer
augggcaagugauugucca

SEQ ID NO: 3651 - RNA, 19 nt, artificial
  Oligomer
aucaaaaagcucucugccu

SEQ ID NO: 3652 - RNA, 19 nt, artificial
  Oligomer
uauaguacugauggucagg

SEQ ID NO: 3653 - RNA, 19 nt, artificial
  Oligomer
aucuguuugcagucugcgg

SEQ ID NO: 3654 - RNA, 19 nt, artificial
  Oligomer
cgaaccaaguaggaaaccc

SEQ ID NO: 3655 - RNA, 19 nt, artificial
  Oligomer
gaugggcaagugauugucc

SEQ ID NO: 3656 - RNA, 19 nt, artificial
  Oligomer
uagcaaaugcuuaggcugc

SEQ ID NO: 3657 - RNA, 19 nt, artificial
  Oligomer
ucaaaaagcucucugccug

SEQ ID NO: 3658 - RNA, 19 nt, artificial
  Oligomer
cuacaggcaauguagcucc

SEQ ID NO: 3659 - RNA, 19 nt, artificial
  Oligomer
ugcaaaugagauagauugc

SEQ ID NO: 3660 - RNA, 19 nt, artificial
  Oligomer
acuuugucguugggaugca

SEQ ID NO: 3661 - RNA, 19 nt, artificial
  Oligomer
gugagagugauuggcauuc

SEQ ID NO: 3662 - RNA, 19 nt, artificial
  Oligomer
ucccaugacuuugucguug

SEQ ID NO: 3663 - RNA, 19 nt, artificial
  Oligomer
aguagcaaaugcuuaggcu

SEQ ID NO: 3664 - RNA, 19 nt, artificial
  Oligomer
agcaaaugcuuaggcugcc

SEQ ID NO: 3665 - RNA, 19 nt, artificial
  Oligomer
auaguacugauggucaggu

SEQ ID NO: 3666 - RNA, 19 nt, artificial
  Oligomer
uaguacugauggucaggug

SEQ ID NO: 3667 - RNA, 19 nt, artificial
  Oligomer
augcugagccaucaaagcc

SEQ ID NO: 3668 - RNA, 19 nt, artificial
  Oligomer
auagauugcaugugguggu

SEQ ID NO: 3669 - RNA, 19 nt, artificial
  Oligomer
ugaucuguuugcagucugc

SEQ ID NO: 3670 - RNA, 19 nt, artificial
  Oligomer
aaggugacugacacuuuca

SEQ ID NO: 3671 - RNA, 19 nt, artificial
  Oligomer
caucaaaaagcucucugcc

SEQ ID NO: 3672 - RNA, 19 nt, artificial
  Oligomer
aauguagcucccaaguggc

SEQ ID NO: 3673 - RNA, 19 nt, artificial
  Oligomer
uuuggcaacauaggcgaca

SEQ ID NO: 3674 - RNA, 19 nt, artificial
  Oligomer
auugacuggaggaccucca

SEQ ID NO: 3675 - RNA, 19 nt, artificial
  Oligomer
ugguagcugauaaggugac

SEQ ID NO: 3676 - RNA, 19 nt, artificial
  Oligomer
gacacuuucaaagcgguga

SEQ ID NO: 3677 - RNA, 19 nt, artificial
  Oligomer
ccaguagcaaaugcuuagg

SEQ ID NO: 3678 - RNA, 19 nt, artificial
  Oligomer
aagagcaucuucgaagggc

SEQ ID NO: 3679 - RNA, 19 nt, artificial
  Oligomer
ugcacugccauugauagca

SEQ ID NO: 3680 - RNA, 19 nt, artificial
  Oligomer
aaagccagccauccuguca

SEQ ID NO: 3681 - RNA, 19 nt, artificial
  Oligomer
uugaagcgcaacucgaagg

SEQ ID NO: 3682 - RNA, 19 nt, artificial
  Oligomer
uucacagggucuuuggcaa

SEQ ID NO: 3683 - RNA, 19 nt, artificial
  Oligomer
gcaaaugagauagauugca

SEQ ID NO: 3684 - RNA, 19 nt, artificial
  Oligomer
ugcuguagacacaguucgc

SEQ ID NO: 3685 - RNA, 19 nt, artificial
  Oligomer
aagccagugagcacauacu

SEQ ID NO: 3686 - RNA, 19 nt, artificial
  Oligomer
ugcugagccaucaaagcca

SEQ ID NO: 3687 - RNA, 19 nt, artificial
  Oligomer
gaugaucuguuugcagucu

SEQ ID NO: 3688 - RNA, 19 nt, artificial
  Oligomer
gacuuugucguugggaugc

SEQ ID NO: 3689 - RNA, 19 nt, artificial
  Oligomer
uuugucguugggaugcagc

SEQ ID NO: 3690 - RNA, 19 nt, artificial
  Oligomer
uccaccaguagcaaaugcu

SEQ ID NO: 3691 - RNA, 19 nt, artificial
  Oligomer
ucuagguucuggacguuga

SEQ ID NO: 3692 - RNA, 19 nt, artificial
  Oligomer
auucacagggucuuuggca

SEQ ID NO: 3693 - RNA, 19 nt, artificial
  Oligomer
gauugcauguggugguugg

SEQ ID NO: 3694 - RNA, 19 nt, artificial
  Oligomer
uggcgaugaucuguuugca

SEQ ID NO: 3695 - RNA, 19 nt, artificial
  Oligomer
cccaugacuuugucguugg

SEQ ID NO: 3696 - RNA, 19 nt, artificial
  Oligomer
ggcuuauugacaaagcucc

SEQ ID NO: 3697 - RNA, 19 nt, artificial
  Oligomer
cacugccauugauagcagg

SEQ ID NO: 3698 - RNA, 19 nt, artificial
  Oligomer
auguagcucccaaguggcu

SEQ ID NO: 3699 - RNA, 19 nt, artificial
  Oligomer
aguacugauggucaggugg

SEQ ID NO: 3700 - RNA, 19 nt, artificial
  Oligomer
gauucacagggucuuuggc

SEQ ID NO: 3701 - RNA, 19 nt, artificial
  Oligomer
uagauugcauguggugguu

SEQ ID NO: 3702 - RNA, 19 nt, artificial
  Oligomer
gugggcuuauugacaaagc

SEQ ID NO: 3703 - RNA, 19 nt, artificial
  Oligomer
guagcugauaaggugacug

SEQ ID NO: 3704 - RNA, 19 nt, artificial
  Oligomer
uucgaagggcuucauguca

SEQ ID NO: 3705 - RNA, 19 nt, artificial
  Oligomer
acacuccagaauguggcag

SEQ ID NO: 3706 - RNA, 19 nt, artificial
  Oligomer
auugcauguggugguuggc

SEQ ID NO: 3707 - RNA, 19 nt, artificial
  Oligomer
gaucuguuugcagucugcg

SEQ ID NO: 3708 - RNA, 19 nt, artificial
  Oligomer
ugugguagcugauaaggug

SEQ ID NO: 3709 - RNA, 19 nt, artificial
  Oligomer
uggugcugaugacauccug

SEQ ID NO: 3710 - RNA, 19 nt, artificial
  Oligomer
agugagcacauacuggcca

SEQ ID NO: 3711 - RNA, 19 nt, artificial
  Oligomer
auggugcugaugacauccu

SEQ ID NO: 3712 - RNA, 19 nt, artificial
  Oligomer
gaagagcaucuucgaaggg

SEQ ID NO: 3713 - RNA, 19 nt, artificial
  Oligomer
aagggcuucaugucaaaca

SEQ ID NO: 3714 - RNA, 19 nt, artificial
  Oligomer
agggcuucaugucaaacag

SEQ ID NO: 3715 - RNA, 19 nt, artificial
  Oligomer
aauggugcugaugacaucc

SEQ ID NO: 3716 - RNA, 19 nt, artificial
  Oligomer
auguggugguuggcgauga

SEQ ID NO: 3717 - RNA, 19 nt, artificial
  Oligomer
uuuuccauuauaagaaccc

SEQ ID NO: 3718 - RNA, 19 nt, artificial
  Oligomer
gauuguacuugggcuuggg

SEQ ID NO: 3719 - RNA, 19 nt, artificial
  Oligomer
aucaucagcugcccuuccu

SEQ ID NO: 3720 - RNA, 21 nt, artificial
  Oligomer
ugaugaucccuccuaugucaa

SEQ ID NO: 3721 - RNA, 21 nt, artificial
  Oligomer
cuuuuugaugaucccuccuau

SEQ ID NO: 3722 - RNA, 21 nt, artificial
  Oligomer
ccacaugcaaucuaucucauu

SEQ ID NO: 3723 - RNA, 21 nt, artificial
  Oligomer
gcuuuuugaugaucccuccua

SEQ ID NO: 3724 - RNA, 21 nt, artificial
  Oligomer
agcuuuuugaugaucccuccu

SEQ ID NO: 3725 - RNA, 21 nt, artificial
  Oligomer
gcagagagcuuuuugaugauc

SEQ ID NO: 3726 - RNA, 21 nt, artificial
  Oligomer
cgaguugcgcuucaaacaaua

SEQ ID NO: 3727 - RNA, 21 nt, artificial
  Oligomer
uaaccugaaauuugcuggaau

SEQ ID NO: 3728 - RNA, 21 nt, artificial
  Oligomer
guaaccugaaauuugcuggaa

SEQ ID NO: 3729 - RNA, 21 nt, artificial
  Oligomer
ccgcuuugaaagugucaguca

SEQ ID NO: 3730 - RNA, 21 nt, artificial
  Oligomer
ugaucccuccuaugucaacgu

SEQ ID NO: 3731 - RNA, 21 nt, artificial
  Oligomer
ccacgggagcuuugucaauaa

SEQ ID NO: 3732 - RNA, 21 nt, artificial
  Oligomer
acaugcaaucuaucucauuug

SEQ ID NO: 3733 - RNA, 21 nt, artificial
  Oligomer
accacaugcaaucuaucucau

SEQ ID NO: 3734 - RNA, 21 nt, artificial
  Oligomer
ggacuaaggaucaccgcuuug

SEQ ID NO: 3735 - RNA, 21 nt, artificial
  Oligomer
guagacaugaggcuucgggaa

SEQ ID NO: 3736 - RNA, 21 nt, artificial
  Oligomer
aaccugaaauuugcuggaaug

SEQ ID NO: 3737 - RNA, 21 nt, artificial
  Oligomer
ccgggaccuguuugacaugaa

SEQ ID NO: 3738 - RNA, 21 nt, artificial
  Oligomer
uccuaugucaacguccagaac

SEQ ID NO: 3739 - RNA, 21 nt, artificial
  Oligomer
cacaugcaaucuaucucauuu

SEQ ID NO: 3740 - RNA, 21 nt, artificial
  Oligomer
ggacaugaacaagcugagugg

SEQ ID NO: 3741 - RNA, 21 nt, artificial
  Oligomer
cuucaaacaauaccucaggaa

SEQ ID NO: 3742 - RNA, 21 nt, artificial
  Oligomer
caccacaugcaaucuaucuca

SEQ ID NO: 3743 - RNA, 21 nt, artificial
  Oligomer
ccaccacaugcaaucuaucuc

SEQ ID NO: 3744 - RNA, 21 nt, artificial
  Oligomer
gguuuccuacuugguucggua

SEQ ID NO: 3745 - RNA, 21 nt, artificial
  Oligomer
cagcuaccacauggacaauca

SEQ ID NO: 3746 - RNA, 21 nt, artificial
  Oligomer
gguucgguacauggguugugu

SEQ ID NO: 3747 - RNA, 21 nt, artificial
  Oligomer
acuaaggaucaccgcuuugaa

SEQ ID NO: 3748 - RNA, 21 nt, artificial
  Oligomer
cgggaccuguuugacaugaag

SEQ ID NO: 3749 - RNA, 21 nt, artificial
  Oligomer
gcuucaaacaauaccucagga

SEQ ID NO: 3750 - RNA, 21 nt, artificial
  Oligomer
cgcuucaaacaauaccucagg

SEQ ID NO: 3751 - RNA, 21 nt, artificial
  Oligomer
guacauggguuguguggaggu

SEQ ID NO: 3752 - RNA, 21 nt, artificial
  Oligomer
ggugugguucggacuaaggau

SEQ ID NO: 3753 - RNA, 21 nt, artificial
  Oligomer
ugagggugugguucggacuaa

SEQ ID NO: 3754 - RNA, 21 nt, artificial
  Oligomer
gcgcuucaaacaauaccucag

SEQ ID NO: 3755 - RNA, 21 nt, artificial
  Oligomer
ugcgcuucaaacaauaccuca

SEQ ID NO: 3756 - RNA, 21 nt, artificial
  Oligomer
gaguugcgcuucaaacaauac

SEQ ID NO: 3757 - RNA, 21 nt, artificial
  Oligomer
ucgaguugcgcuucaaacaau

SEQ ID NO: 3758 - RNA, 21 nt, artificial
  Oligomer
cacgggagcuuugucaauaag

SEQ ID NO: 3759 - RNA, 21 nt, artificial
  Oligomer
ggacaaucacuugcccaucau

SEQ ID NO: 3760 - RNA, 21 nt, artificial
  Oligomer
ccaucaguacuauaaugacuu

SEQ ID NO: 3761 - RNA, 21 nt, artificial
  Oligomer
gggaccuguuugacaugaagc

SEQ ID NO: 3762 - RNA, 21 nt, artificial
  Oligomer
gagauccagaaguccgcaaac

SEQ ID NO: 3763 - RNA, 21 nt, artificial
  Oligomer
ggguuuccuacuugguucggu

SEQ ID NO: 3764 - RNA, 21 nt, artificial
  Oligomer
gccgaguaugucgccuauguu

SEQ ID NO: 3765 - RNA, 21 nt, artificial
  Oligomer
ggagauccagaaguccgcaaa

SEQ ID NO: 3766 - RNA, 21 nt, artificial
  Oligomer
ggaguaaccugaaauuugcug

SEQ ID NO: 3767 - RNA, 21 nt, artificial
  Oligomer
gggaggaguaaccugaaauuu

SEQ ID NO: 3768 - RNA, 21 nt, artificial
  Oligomer
ugaaauuugcuggaaugccaa

SEQ ID NO: 3769 - RNA, 21 nt, artificial
  Oligomer
ugaaagugucagucaccuuau

SEQ ID NO: 3770 - RNA, 21 nt, artificial
  Oligomer
ggcagagagcuuuuugaugau

SEQ ID NO: 3771 - RNA, 21 nt, artificial
  Oligomer
ccugaccaucaguacuauaau

SEQ ID NO: 3772 - RNA, 21 nt, artificial
  Oligomer
gccaccugaccaucaguacua

SEQ ID NO: 3773 - RNA, 21 nt, artificial
  Oligomer
gggcagccuaagcauuugcua

SEQ ID NO: 3774 - RNA, 21 nt, artificial
  Oligomer
guaugugcucacuggcuugca

SEQ ID NO: 3775 - RNA, 21 nt, artificial
  Oligomer
gacaugaagcccuucgaagau

SEQ ID NO: 3776 - RNA, 21 nt, artificial
  Oligomer
cgcagacugcaaacagaucau

SEQ ID NO: 3777 - RNA, 21 nt, artificial
  Oligomer
gcgaacugugucuacagcaac

SEQ ID NO: 3778 - RNA, 21 nt, artificial
  Oligomer
cggacuaaggaucaccgcuuu

SEQ ID NO: 3779 - RNA, 21 nt, artificial
  Oligomer
ccagaaguccgcaaacagaug

SEQ ID NO: 3780 - RNA, 21 nt, artificial
  Oligomer
ggaggaguaaccugaaauuug

SEQ ID NO: 3781 - RNA, 21 nt, artificial
  Oligomer
cuaccacauggacaaucacuu

SEQ ID NO: 3782 - RNA, 21 nt, artificial
  Oligomer
caacguccagaaccuagacaa

SEQ ID NO: 3783 - RNA, 21 nt, artificial
  Oligomer
ugaccaucaguacuauaauga

SEQ ID NO: 3784 - RNA, 21 nt, artificial
  Oligomer
acagccgaguaugucgccuau

SEQ ID NO: 3785 - RNA, 21 nt, artificial
  Oligomer
cuccuaugucaacguccagaa

SEQ ID NO: 3786 - RNA, 21 nt, artificial
  Oligomer
ggagcuacauugccuguagga

SEQ ID NO: 3787 - RNA, 21 nt, artificial
  Oligomer
gacaggauggcuggcuuugau

SEQ ID NO: 3788 - RNA, 21 nt, artificial
  Oligomer
ccaaagacccugugaaucaga

SEQ ID NO: 3789 - RNA, 21 nt, artificial
  Oligomer
cugcaaacagaucaucgccaa

SEQ ID NO: 3790 - RNA, 21 nt, artificial
  Oligomer
cuaaggaucaccgcuuugaaa

SEQ ID NO: 3791 - RNA, 21 nt, artificial
  Oligomer
gaccaucaguacuauaaugac

SEQ ID NO: 3792 - RNA, 21 nt, artificial
  Oligomer
ccaccugaccaucaguacuau

SEQ ID NO: 3793 - RNA, 21 nt, artificial
  Oligomer
ucaugacaggauggcuggcuu

SEQ ID NO: 3794 - RNA, 21 nt, artificial
  Oligomer
gcaaucuaucucauuugcauc

SEQ ID NO: 3795 - RNA, 21 nt, artificial
  Oligomer
gcagacugcaaacagaucauc

SEQ ID NO: 3796 - RNA, 21 nt, artificial
  Oligomer
caaggaggagaaagcccugua

SEQ ID NO: 3797 - RNA, 21 nt, artificial
  Oligomer
agcgaacugugucuacagcaa

SEQ ID NO: 3798 - RNA, 21 nt, artificial
  Oligomer
gccuaagcauuugcuacuggu

SEQ ID NO: 3799 - RNA, 21 nt, artificial
  Oligomer
gagagcuuuuugaugaucccu

SEQ ID NO: 3800 - RNA, 21 nt, artificial
  Oligomer
guaugucgccuauguugccaa

SEQ ID NO: 3801 - RNA, 21 nt, artificial
  Oligomer
gaacugugucuacagcaaccu

SEQ ID NO: 3802 - RNA, 21 nt, artificial
  Oligomer
gacaaucacuugcccaucauc

SEQ ID NO: 3803 - RNA, 21 nt, artificial
  Oligomer
ccacauggacaaucacuugcc

SEQ ID NO: 3804 - RNA, 21 nt, artificial
  Oligomer
agagagcuuuuugaugauccc

SEQ ID NO: 3805 - RNA, 21 nt, artificial
  Oligomer
caugacaggauggcuggcuuu

SEQ ID NO: 3806 - RNA, 21 nt, artificial
  Oligomer
gccuucgaguugcgcuucaaa

SEQ ID NO: 3807 - RNA, 21 nt, artificial
  Oligomer
ccgaguaugucgccuauguug

SEQ ID NO: 3808 - RNA, 21 nt, artificial
  Oligomer
ccaaccaccacaugcaaucua

SEQ ID NO: 3809 - RNA, 21 nt, artificial
  Oligomer
ugccaaucacucucaccgucu

SEQ ID NO: 3810 - RNA, 21 nt, artificial
  Oligomer
ggaaugccaaucacucucacc

SEQ ID NO: 3811 - RNA, 21 nt, artificial
  Oligomer
uggcugcaucccaacgacaaa

SEQ ID NO: 3812 - RNA, 21 nt, artificial
  Oligomer
agcuaccacauggacaaucac

SEQ ID NO: 3813 - RNA, 21 nt, artificial
  Oligomer
ggaucaccgcuuugaaagugu

SEQ ID NO: 3814 - RNA, 21 nt, artificial
  Oligomer
caccugaccaucaguacuaua

SEQ ID NO: 3815 - RNA, 21 nt, artificial
  Oligomer
gucgccuauguugccaaagac

SEQ ID NO: 3816 - RNA, 21 nt, artificial
  Oligomer
gaaauuugcuggaaugccaau

SEQ ID NO: 3817 - RNA, 21 nt, artificial
  Oligomer
uccuacuugguucgguacaug

SEQ ID NO: 3818 - RNA, 21 nt, artificial
  Oligomer
acauggacaaucacuugccca

SEQ ID NO: 3819 - RNA, 21 nt, artificial
  Oligomer
gucagucaccuuaucagcuac

SEQ ID NO: 3820 - RNA, 21 nt, artificial
  Oligomer
caccgcuuugaaagugucagu

SEQ ID NO: 3821 - RNA, 21 nt, artificial
  Oligomer
uccagaaguccgcaaacagau

SEQ ID NO: 3822 - RNA, 21 nt, artificial
  Oligomer
acaggauggcuggcuuugaug

SEQ ID NO: 3823 - RNA, 21 nt, artificial
  Oligomer
gccaaagacccugugaaucag

SEQ ID NO: 3824 - RNA, 21 nt, artificial
  Oligomer
guugccaaagacccugugaau

SEQ ID NO: 3825 - RNA, 21 nt, artificial
  Oligomer
caaccaccacaugcaaucuau

SEQ ID NO: 3826 - RNA, 21 nt, artificial
  Oligomer
cuggaaugccaaucacucuca

SEQ ID NO: 3827 - RNA, 21 nt, artificial
  Oligomer
ucaccuuaucagcuaccacau

SEQ ID NO: 3828 - RNA, 21 nt, artificial
  Oligomer
cgcuuugaaagugucagucac

SEQ ID NO: 3829 - RNA, 21 nt, artificial
  Oligomer
ccuaagcauuugcuacuggug

SEQ ID NO: 3830 - RNA, 21 nt, artificial
  Oligomer
gcagccuaagcauuugcuacu

SEQ ID NO: 3831 - RNA, 21 nt, artificial
  Oligomer
cuggcuuugauggcucagcau

SEQ ID NO: 3832 - RNA, 21 nt, artificial
  Oligomer
cacauucuggagugucccgaa

SEQ ID NO: 3833 - RNA, 21 nt, artificial
  Oligomer
ugcaaucuaucucauuugcau

SEQ ID NO: 3834 - RNA, 21 nt, artificial
  Oligomer
uggaaugccaaucacucucac

SEQ ID NO: 3835 - RNA, 21 nt, artificial
  Oligomer
ccuuaucagcuaccacaugga

SEQ ID NO: 3836 - RNA, 21 nt, artificial
  Oligomer
cagccuaagcauuugcuacug

SEQ ID NO: 3837 - RNA, 21 nt, artificial
  Oligomer
ccugcuaucaauggcagugca

SEQ ID NO: 3838 - RNA, 21 nt, artificial
  Oligomer
accugaccaucaguacuauaa

SEQ ID NO: 3839 - RNA, 21 nt, artificial
  Oligomer
caaacagaucaucgccaacca

SEQ ID NO: 3840 - RNA, 21 nt, artificial
  Oligomer
ccaacgacaaagucaugggac

SEQ ID NO: 3841 - RNA, 21 nt, artificial
  Oligomer
cagcgaacugugucuacagca

SEQ ID NO: 3842 - RNA, 21 nt, artificial
  Oligomer
gcuuugaaagugucagucacc

SEQ ID NO: 3843 - RNA, 21 nt, artificial
  Oligomer
ucggacuaaggaucaccgcuu

SEQ ID NO: 3844 - RNA, 21 nt, artificial
  Oligomer
ccaguaugugcucacuggcuu

SEQ ID NO: 3845 - RNA, 21 nt, artificial
  Oligomer
cugcuaucaauggcagugcac

SEQ ID NO: 3846 - RNA, 21 nt, artificial
  Oligomer
gcugcaucccaacgacaaagu

SEQ ID NO: 3847 - RNA, 21 nt, artificial
  Oligomer
aaagugucagucaccuuauca

SEQ ID NO: 3848 - RNA, 21 nt, artificial
  Oligomer
ccaggaugucaucagcaccau

SEQ ID NO: 3849 - RNA, 21 nt, artificial
  Oligomer
gccuauguugccaaagacccu

SEQ ID NO: 3850 - RNA, 21 nt, artificial
  Oligomer
gccaaccaccacaugcaaucu

SEQ ID NO: 3851 - RNA, 21 nt, artificial
  Oligomer
ugcaaacagaucaucgccaac

SEQ ID NO: 3852 - RNA, 21 nt, artificial
  Oligomer
gccacgggagcuuugucaaua

SEQ ID NO: 3853 - RNA, 21 nt, artificial
  Oligomer
gucaacguccagaaccuagac

SEQ ID NO: 3854 - RNA, 21 nt, artificial
  Oligomer
acauugccuguaggacagccu

SEQ ID NO: 3855 - RNA, 21 nt, artificial
  Oligomer
ugggagcuacauugccuguag

SEQ ID NO: 3856 - RNA, 21 nt, artificial
  Oligomer
cagccacuugggagcuacauu

SEQ ID NO: 3857 - RNA, 21 nt, artificial
  Oligomer
acccugugaaucagagagccu

SEQ ID NO: 3858 - RNA, 21 nt, artificial
  Oligomer
ccgcagacugcaaacagauca

SEQ ID NO: 3859 - RNA, 21 nt, artificial
  Oligomer
cugcaucccaacgacaaaguc

SEQ ID NO: 3860 - RNA, 21 nt, artificial
  Oligomer
gagcuuugucaauaagcccac

SEQ ID NO: 3861 - RNA, 21 nt, artificial
  Oligomer
cagucaccuuaucagcuacca

SEQ ID NO: 3862 - RNA, 21 nt, artificial
  Oligomer
ccuguuugacaugaagcccuu

SEQ ID NO: 3863 - RNA, 21 nt, artificial
  Oligomer
cuauguugccaaagacccugu

SEQ ID NO: 3864 - RNA, 21 nt, artificial
  Oligomer
ggagcuuugucaauaagccca

SEQ ID NO: 3865 - RNA, 21 nt, artificial
  Oligomer
gggagcuuugucaauaagccc

SEQ ID NO: 3866 - RNA, 21 nt, artificial
  Oligomer
cugugucuacagcaaccugug

SEQ ID NO: 3867 - RNA, 21 nt, artificial
  Oligomer
caguaugugcucacuggcuug

SEQ ID NO: 3868 - RNA, 21 nt, artificial
  Oligomer
ccaauccugcuaucaauggca

SEQ ID NO: 3869 - RNA, 21 nt, artificial
  Oligomer
aggaguaaccugaaauuugcu

SEQ ID NO: 3870 - RNA, 21 nt, artificial
  Oligomer
caggaugucaucagcaccauu

SEQ ID NO: 3871 - RNA, 21 nt, artificial
  Oligomer
gcaucccaacgacaaagucau

SEQ ID NO: 3872 - RNA, 21 nt, artificial
  Oligomer
cuguuugacaugaagcccuuc

SEQ ID NO: 3873 - RNA, 21 nt, artificial
  Oligomer
ucagagagccugccacauucu

SEQ ID NO: 3874 - RNA, 21 nt, artificial
  Oligomer
ugaaucagagagccugccaca

SEQ ID NO: 3875 - RNA, 21 nt, artificial
  Oligomer
cccaacgacaaagucauggga

SEQ ID NO: 3876 - RNA, 21 nt, artificial
  Oligomer
ggaugucaucagcaccauugg

SEQ ID NO: 3877 - RNA, 21 nt, artificial
  Oligomer
gaucaucgccaaccaccacau

SEQ ID NO: 3878 - RNA, 21 nt, artificial
  Oligomer
uugacauaggagggaucauca

SEQ ID NO: 3879 - RNA, 21 nt, artificial
  Oligomer
auaggagggaucaucaaaaag

SEQ ID NO: 3880 - RNA, 21 nt, artificial
  Oligomer
aaugagauagauugcaugugg

SEQ ID NO: 3881 - RNA, 21 nt, artificial
  Oligomer
uaggagggaucaucaaaaagc

SEQ ID NO: 3882 - RNA, 21 nt, artificial
  Oligomer
aggagggaucaucaaaaagcu

SEQ ID NO: 3883 - RNA, 21 nt, artificial
  Oligomer
gaucaucaaaaagcucucugc

SEQ ID NO: 3884 - RNA, 21 nt, artificial
  Oligomer
uauuguuugaagcgcaacucg

SEQ ID NO: 3885 - RNA, 21 nt, artificial
  Oligomer
auuccagcaaauuucagguua

SEQ ID NO: 3886 - RNA, 21 nt, artificial
  Oligomer
uuccagcaaauuucagguuac

SEQ ID NO: 3887 - RNA, 21 nt, artificial
  Oligomer
ugacugacacuuucaaagcgg

SEQ ID NO: 3888 - RNA, 21 nt, artificial
  Oligomer
acguugacauaggagggauca

SEQ ID NO: 3889 - RNA, 21 nt, artificial
  Oligomer
uuauugacaaagcucccgugg

SEQ ID NO: 3890 - RNA, 21 nt, artificial
  Oligomer
caaaugagauagauugcaugu

SEQ ID NO: 3891 - RNA, 21 nt, artificial
  Oligomer
augagauagauugcauguggu

SEQ ID NO: 3892 - RNA, 21 nt, artificial
  Oligomer
caaagcggugauccuuagucc

SEQ ID NO: 3893 - RNA, 21 nt, artificial
  Oligomer
uucccgaagccucaugucuac

SEQ ID NO: 3894 - RNA, 21 nt, artificial
  Oligomer
cauuccagcaaauuucagguu

SEQ ID NO: 3895 - RNA, 21 nt, artificial
  Oligomer
uucaugucaaacaggucccgg

SEQ ID NO: 3896 - RNA, 21 nt, artificial
  Oligomer
guucuggacguugacauagga

SEQ ID NO: 3897 - RNA, 21 nt, artificial
  Oligomer
aaaugagauagauugcaugug

SEQ ID NO: 3898 - RNA, 21 nt, artificial
  Oligomer
ccacucagcuuguucaugucc

SEQ ID NO: 3899 - RNA, 21 nt, artificial
  Oligomer
uuccugagguauuguuugaag

SEQ ID NO: 3900 - RNA, 21 nt, artificial
  Oligomer
ugagauagauugcauguggug

SEQ ID NO: 3901 - RNA, 21 nt, artificial
  Oligomer
gagauagauugcauguggugg

SEQ ID NO: 3902 - RNA, 21 nt, artificial
  Oligomer
uaccgaaccaaguaggaaacc

SEQ ID NO: 3903 - RNA, 21 nt, artificial
  Oligomer
ugauuguccaugugguagcug

SEQ ID NO: 3904 - RNA, 21 nt, artificial
  Oligomer
acacaacccauguaccgaacc

SEQ ID NO: 3905 - RNA, 21 nt, artificial
  Oligomer
uucaaagcggugauccuuagu

SEQ ID NO: 3906 - RNA, 21 nt, artificial
  Oligomer
cuucaugucaaacaggucccg

SEQ ID NO: 3907 - RNA, 21 nt, artificial
  Oligomer
uccugagguauuguuugaagc

SEQ ID NO: 3908 - RNA, 21 nt, artificial
  Oligomer
ccugagguauuguuugaagcg

SEQ ID NO: 3909 - RNA, 21 nt, artificial
  Oligomer
accuccacacaacccauguac

SEQ ID NO: 3910 - RNA, 21 nt, artificial
  Oligomer
auccuuaguccgaaccacacc

SEQ ID NO: 3911 - RNA, 21 nt, artificial
  Oligomer
uuaguccgaaccacacccuca

SEQ ID NO: 3912 - RNA, 21 nt, artificial
  Oligomer
cugagguauuguuugaagcgc

SEQ ID NO: 3913 - RNA, 21 nt, artificial
  Oligomer
ugagguauuguuugaagcgca

SEQ ID NO: 3914 - RNA, 21 nt, artificial
  Oligomer
guauuguuugaagcgcaacuc

SEQ ID NO: 3915 - RNA, 21 nt, artificial
  Oligomer
auuguuugaagcgcaacucga

SEQ ID NO: 3916 - RNA, 21 nt, artificial
  Oligomer
cuuauugacaaagcucccgug

SEQ ID NO: 3917 - RNA, 21 nt, artificial
  Oligomer
augaugggcaagugauugucc

SEQ ID NO: 3918 - RNA, 21 nt, artificial
  Oligomer
aagucauuauaguacugaugg

SEQ ID NO: 3919 - RNA, 21 nt, artificial
  Oligomer
gcuucaugucaaacagguccc

SEQ ID NO: 3920 - RNA, 21 nt, artificial
  Oligomer
guuugcggacuucuggaucuc

SEQ ID NO: 3921 - RNA, 21 nt, artificial
  Oligomer
accgaaccaaguaggaaaccc

SEQ ID NO: 3922 - RNA, 21 nt, artificial
  Oligomer
aacauaggcgacauacucggc

SEQ ID NO: 3923 - RNA, 21 nt, artificial
  Oligomer
uuugcggacuucuggaucucc

SEQ ID NO: 3924 - RNA, 21 nt, artificial
  Oligomer
cagcaaauuucagguuacucc

SEQ ID NO: 3925 - RNA, 21 nt, artificial
  Oligomer
aaauuucagguuacuccuccc

SEQ ID NO: 3926 - RNA, 21 nt, artificial
  Oligomer
uuggcauuccagcaaauuuca

SEQ ID NO: 3927 - RNA, 21 nt, artificial
  Oligomer
auaaggugacugacacuuuca

SEQ ID NO: 3928 - RNA, 21 nt, artificial
  Oligomer
aucaucaaaaagcucucugcc

SEQ ID NO: 3929 - RNA, 21 nt, artificial
  Oligomer
auuauaguacugauggucagg

SEQ ID NO: 3930 - RNA, 21 nt, artificial
  Oligomer
uaguacugauggucagguggc

SEQ ID NO: 3931 - RNA, 21 nt, artificial
  Oligomer
uagcaaaugcuuaggcugccc

SEQ ID NO: 3932 - RNA, 21 nt, artificial
  Oligomer
ugcaagccagugagcacauac

SEQ ID NO: 3933 - RNA, 21 nt, artificial
  Oligomer
aucuucgaagggcuucauguc

SEQ ID NO: 3934 - RNA, 21 nt, artificial
  Oligomer
augaucuguuugcagucugcg

SEQ ID NO: 3935 - RNA, 21 nt, artificial
  Oligomer
guugcuguagacacaguucgc

SEQ ID NO: 3936 - RNA, 21 nt, artificial
  Oligomer
aaagcggugauccuuaguccg

SEQ ID NO: 3937 - RNA, 21 nt, artificial
  Oligomer
caucuguuugcggacuucugg

SEQ ID NO: 3938 - RNA, 21 nt, artificial
  Oligomer
caaauuucagguuacuccucc

SEQ ID NO: 3939 - RNA, 21 nt, artificial
  Oligomer
aagugauuguccaugugguag

SEQ ID NO: 3940 - RNA, 21 nt, artificial
  Oligomer
uugucuagguucuggacguug

SEQ ID NO: 3941 - RNA, 21 nt, artificial
  Oligomer
ucauuauaguacugaugguca

SEQ ID NO: 3942 - RNA, 21 nt, artificial
  Oligomer
auaggcgacauacucggcugu

SEQ ID NO: 3943 - RNA, 21 nt, artificial
  Oligomer
uucuggacguugacauaggag

SEQ ID NO: 3944 - RNA, 21 nt, artificial
  Oligomer
uccuacaggcaauguagcucc

SEQ ID NO: 3945 - RNA, 21 nt, artificial
  Oligomer
aucaaagccagccauccuguc

SEQ ID NO: 3946 - RNA, 21 nt, artificial
  Oligomer
ucugauucacagggucuuugg

SEQ ID NO: 3947 - RNA, 21 nt, artificial
  Oligomer
uuggcgaugaucuguuugcag

SEQ ID NO: 3948 - RNA, 21 nt, artificial
  Oligomer
uuucaaagcggugauccuuag

SEQ ID NO: 3949 - RNA, 21 nt, artificial
  Oligomer
gucauuauaguacugaugguc

SEQ ID NO: 3950 - RNA, 21 nt, artificial
  Oligomer
auaguacugauggucaggugg

SEQ ID NO: 3951 - RNA, 21 nt, artificial
  Oligomer
aagccagccauccugucauga

SEQ ID NO: 3952 - RNA, 21 nt, artificial
  Oligomer
gaugcaaaugagauagauugc

SEQ ID NO: 3953 - RNA, 21 nt, artificial
  Oligomer
gaugaucuguuugcagucugc

SEQ ID NO: 3954 - RNA, 21 nt, artificial
  Oligomer
uacagggcuuucuccuccuug

SEQ ID NO: 3955 - RNA, 21 nt, artificial
  Oligomer
uugcuguagacacaguucgcu

SEQ ID NO: 3956 - RNA, 21 nt, artificial
  Oligomer
accaguagcaaaugcuuaggc

SEQ ID NO: 3957 - RNA, 21 nt, artificial
  Oligomer
agggaucaucaaaaagcucuc

SEQ ID NO: 3958 - RNA, 21 nt, artificial
  Oligomer
uuggcaacauaggcgacauac

SEQ ID NO: 3959 - RNA, 21 nt, artificial
  Oligomer
agguugcuguagacacaguuc

SEQ ID NO: 3960 - RNA, 21 nt, artificial
  Oligomer
gaugaugggcaagugauuguc

SEQ ID NO: 3961 - RNA, 21 nt, artificial
  Oligomer
ggcaagugauuguccaugugg

SEQ ID NO: 3962 - RNA, 21 nt, artificial
  Oligomer
gggaucaucaaaaagcucucu

SEQ ID NO: 3963 - RNA, 21 nt, artificial
  Oligomer
aaagccagccauccugucaug

SEQ ID NO: 3964 - RNA, 21 nt, artificial
  Oligomer
uuugaagcgcaacucgaaggc

SEQ ID NO: 3965 - RNA, 21 nt, artificial
  Oligomer
caacauaggcgacauacucgg

SEQ ID NO: 3966 - RNA, 21 nt, artificial
  Oligomer
uagauugcauguggugguugg

SEQ ID NO: 3967 - RNA, 21 nt, artificial
  Oligomer
agacggugagagugauuggca

SEQ ID NO: 3968 - RNA, 21 nt, artificial
  Oligomer
ggugagagugauuggcauucc

SEQ ID NO: 3969 - RNA, 21 nt, artificial
  Oligomer
uuugucguugggaugcagcca

SEQ ID NO: 3970 - RNA, 21 nt, artificial
  Oligomer
gugauuguccaugugguagcu

SEQ ID NO: 3971 - RNA, 21 nt, artificial
  Oligomer
acacuuucaaagcggugaucc

SEQ ID NO: 3972 - RNA, 21 nt, artificial
  Oligomer
uauaguacugauggucaggug

SEQ ID NO: 3973 - RNA, 21 nt, artificial
  Oligomer
gucuuuggcaacauaggcgac

SEQ ID NO: 3974 - RNA, 21 nt, artificial
  Oligomer
auuggcauuccagcaaauuuc

SEQ ID NO: 3975 - RNA, 21 nt, artificial
  Oligomer
cauguaccgaaccaaguagga

SEQ ID NO: 3976 - RNA, 21 nt, artificial
  Oligomer
ugggcaagugauuguccaugu

SEQ ID NO: 3977 - RNA, 21 nt, artificial
  Oligomer
guagcugauaaggugacugac

SEQ ID NO: 3978 - RNA, 21 nt, artificial
  Oligomer
acugacacuuucaaagcggug

SEQ ID NO: 3979 - RNA, 21 nt, artificial
  Oligomer
aucuguuugcggacuucugga

SEQ ID NO: 3980 - RNA, 21 nt, artificial
  Oligomer
caucaaagccagccauccugu

SEQ ID NO: 3981 - RNA, 21 nt, artificial
  Oligomer
cugauucacagggucuuuggc

SEQ ID NO: 3982 - RNA, 21 nt, artificial
  Oligomer
auucacagggucuuuggcaac

SEQ ID NO: 3983 - RNA, 21 nt, artificial
  Oligomer
auagauugcauguggugguug

SEQ ID NO: 3984 - RNA, 21 nt, artificial
  Oligomer
ugagagugauuggcauuccag

SEQ ID NO: 3985 - RNA, 21 nt, artificial
  Oligomer
augugguagcugauaagguga

SEQ ID NO: 3986 - RNA, 21 nt, artificial
  Oligomer
gugacugacacuuucaaagcg

SEQ ID NO: 3987 - RNA, 21 nt, artificial
  Oligomer
caccaguagcaaaugcuuagg

SEQ ID NO: 3988 - RNA, 21 nt, artificial
  Oligomer
aguagcaaaugcuuaggcugc

SEQ ID NO: 3989 - RNA, 21 nt, artificial
  Oligomer
augcugagccaucaaagccag

SEQ ID NO: 3990 - RNA, 21 nt, artificial
  Oligomer
uucgggacacuccagaaugug

SEQ ID NO: 3991 - RNA, 21 nt, artificial
  Oligomer
augcaaaugagauagauugca

SEQ ID NO: 3992 - RNA, 21 nt, artificial
  Oligomer
gugagagugauuggcauucca

SEQ ID NO: 3993 - RNA, 21 nt, artificial
  Oligomer
uccaugugguagcugauaagg

SEQ ID NO: 3994 - RNA, 21 nt, artificial
  Oligomer
caguagcaaaugcuuaggcug

SEQ ID NO: 3995 - RNA, 21 nt, artificial
  Oligomer
ugcacugccauugauagcagg

SEQ ID NO: 3996 - RNA, 21 nt, artificial
  Oligomer
uuauaguacugauggucaggu

SEQ ID NO: 3997 - RNA, 21 nt, artificial
  Oligomer
ugguuggcgaugaucuguuug

SEQ ID NO: 3998 - RNA, 21 nt, artificial
  Oligomer
gucccaugacuuugucguugg

SEQ ID NO: 3999 - RNA, 21 nt, artificial
  Oligomer
ugcuguagacacaguucgcug

SEQ ID NO: 4000 - RNA, 21 nt, artificial
  Oligomer
ggugacugacacuuucaaagc

SEQ ID NO: 4001 - RNA, 21 nt, artificial
  Oligomer
aagcggugauccuuaguccga

SEQ ID NO: 4002 - RNA, 21 nt, artificial
  Oligomer
aagccagugagcacauacugg

SEQ ID NO: 4003 - RNA, 21 nt, artificial
  Oligomer
gugcacugccauugauagcag

SEQ ID NO: 4004 - RNA, 21 nt, artificial
  Oligomer
acuuugucguugggaugcagc

SEQ ID NO: 4005 - RNA, 21 nt, artificial
  Oligomer
ugauaaggugacugacacuuu

SEQ ID NO: 4006 - RNA, 21 nt, artificial
  Oligomer
auggugcugaugacauccugg

SEQ ID NO: 4007 - RNA, 21 nt, artificial
  Oligomer
agggucuuuggcaacauaggc

SEQ ID NO: 4008 - RNA, 21 nt, artificial
  Oligomer
agauugcauguggugguuggc

SEQ ID NO: 4009 - RNA, 21 nt, artificial
  Oligomer
guuggcgaugaucuguuugca

SEQ ID NO: 4010 - RNA, 21 nt, artificial
  Oligomer
uauugacaaagcucccguggc

SEQ ID NO: 4011 - RNA, 21 nt, artificial
  Oligomer
gucuagguucuggacguugac

SEQ ID NO: 4012 - RNA, 21 nt, artificial
  Oligomer
aggcuguccuacaggcaaugu

SEQ ID NO: 4013 - RNA, 21 nt, artificial
  Oligomer
cuacaggcaauguagcuccca

SEQ ID NO: 4014 - RNA, 21 nt, artificial
  Oligomer
aauguagcucccaaguggcug

SEQ ID NO: 4015 - RNA, 21 nt, artificial
  Oligomer
aggcucucugauucacagggu

SEQ ID NO: 4016 - RNA, 21 nt, artificial
  Oligomer
ugaucuguuugcagucugcgg

SEQ ID NO: 4017 - RNA, 21 nt, artificial
  Oligomer
gacuuugucguugggaugcag

SEQ ID NO: 4018 - RNA, 21 nt, artificial
  Oligomer
gugggcuuauugacaaagcuc

SEQ ID NO: 4019 - RNA, 21 nt, artificial
  Oligomer
ugguagcugauaaggugacug

SEQ ID NO: 4020 - RNA, 21 nt, artificial
  Oligomer
aagggcuucaugucaaacagg

SEQ ID NO: 4021 - RNA, 21 nt, artificial
  Oligomer
acagggucuuuggcaacauag

SEQ ID NO: 4022 - RNA, 21 nt, artificial
  Oligomer
ugggcuuauugacaaagcucc

SEQ ID NO: 4023 - RNA, 21 nt, artificial
  Oligomer
gggcuuauugacaaagcuccc

SEQ ID NO: 4024 - RNA, 21 nt, artificial
  Oligomer
cacagguugcuguagacacag

SEQ ID NO: 4025 - RNA, 21 nt, artificial
  Oligomer
caagccagugagcacauacug

SEQ ID NO: 4026 - RNA, 21 nt, artificial
  Oligomer
ugccauugauagcaggauugg

SEQ ID NO: 4027 - RNA, 21 nt, artificial
  Oligomer
agcaaauuucagguuacuccu

SEQ ID NO: 4028 - RNA, 21 nt, artificial
  Oligomer
aauggugcugaugacauccug

SEQ ID NO: 4029 - RNA, 21 nt, artificial
  Oligomer
augacuuugucguugggaugc

SEQ ID NO: 4030 - RNA, 21 nt, artificial
  Oligomer
gaagggcuucaugucaaacag

SEQ ID NO: 4031 - RNA, 21 nt, artificial
  Oligomer
agaauguggcaggcucucuga

SEQ ID NO: 4032 - RNA, 21 nt, artificial
  Oligomer
uguggcaggcucucugauuca

SEQ ID NO: 4033 - RNA, 21 nt, artificial
  Oligomer
ucccaugacuuugucguuggg

SEQ ID NO: 4034 - RNA, 21 nt, artificial
  Oligomer
ccaauggugcugaugacaucc

SEQ ID NO: 4035 - RNA, 21 nt, artificial
  Oligomer
auguggugguuggcgaugauc

SEQ ID NO: 4036 - RNA, 19 nt, artificial
  Oligomer
ccgaggugaucauuuuaaa

SEQ ID NO: 4037 - RNA, 19 nt, artificial
  Oligomer
cccgaggugaucauuuuaa

SEQ ID NO: 4038 - RNA, 19 nt, artificial
  Oligomer
cgugaccacaucuuuaaaa

SEQ ID NO: 4039 - RNA, 19 nt, artificial
  Oligomer
cccuauaaaacauggcgaa

SEQ ID NO: 4040 - RNA, 19 nt, artificial
  Oligomer
gugaccacaucuuuaaaau

SEQ ID NO: 4041 - RNA, 19 nt, artificial
  Oligomer
gaaaaaacuuucaggcccu

SEQ ID NO: 4042 - RNA, 19 nt, artificial
  Oligomer
cccuggagaaugacaacuu

SEQ ID NO: 4043 - RNA, 19 nt, artificial
  Oligomer
cuauaaaacauggcgaaaa

SEQ ID NO: 4044 - RNA, 19 nt, artificial
  Oligomer
ccgugaccacaucuuuaaa

SEQ ID NO: 4045 - RNA, 19 nt, artificial
  Oligomer
accgugaccacaucuuuaa

SEQ ID NO: 4046 - RNA, 19 nt, artificial
  Oligomer
cagaaagacagaauuucau

SEQ ID NO: 4047 - RNA, 19 nt, artificial
  Oligomer
cggacacuggaaagaaaaa

SEQ ID NO: 4048 - RNA, 19 nt, artificial
  Oligomer
cagugcuguuagaauaaaa

SEQ ID NO: 4049 - RNA, 19 nt, artificial
  Oligomer
gcucauucacccaacaaaa

SEQ ID NO: 4050 - RNA, 19 nt, artificial
  Oligomer
ucauuuuaaacuucgcuuc

SEQ ID NO: 4051 - RNA, 19 nt, artificial
  Oligomer
gaggugaucauuuuaaacu

SEQ ID NO: 4052 - RNA, 19 nt, artificial
  Oligomer
cgaggugaucauuuuaaac

SEQ ID NO: 4053 - RNA, 19 nt, artificial
  Oligomer
gcggacacuggaaagaaaa

SEQ ID NO: 4054 - RNA, 19 nt, artificial
  Oligomer
cgccacguaaugagucaaa

SEQ ID NO: 4055 - RNA, 19 nt, artificial
  Oligomer
ccuucagaaagacagaauu

SEQ ID NO: 4056 - RNA, 19 nt, artificial
  Oligomer
ccuauaaaacauggcgaaa

SEQ ID NO: 4057 - RNA, 19 nt, artificial
  Oligomer
acagcaucuucacaaggac

SEQ ID NO: 4058 - RNA, 19 nt, artificial
  Oligomer
cacagcaucuucacaagga

SEQ ID NO: 4059 - RNA, 19 nt, artificial
  Oligomer
cccagugcuguuagaauaa

SEQ ID NO: 4060 - RNA, 19 nt, artificial
  Oligomer
acccgaggugaucauuuua

SEQ ID NO: 4061 - RNA, 19 nt, artificial
  Oligomer
aacccgaggugaucauuuu

SEQ ID NO: 4062 - RNA, 19 nt, artificial
  Oligomer
gcccuggagaaugacaacu

SEQ ID NO: 4063 - RNA, 19 nt, artificial
  Oligomer
acaccgugaccacaucuuu

SEQ ID NO: 4064 - RNA, 19 nt, artificial
  Oligomer
gcaucuucacaaggaccaa

SEQ ID NO: 4065 - RNA, 19 nt, artificial
  Oligomer
gaucacagcaucuucacaa

SEQ ID NO: 4066 - RNA, 19 nt, artificial
  Oligomer
ggagcagaacuugagugug

SEQ ID NO: 4067 - RNA, 19 nt, artificial
  Oligomer
ugaucauuuuaaacuucgc

SEQ ID NO: 4068 - RNA, 19 nt, artificial
  Oligomer
gugaucauuuuaaacuucg

SEQ ID NO: 4069 - RNA, 19 nt, artificial
  Oligomer
cuggaaagaaaaagaagaa

SEQ ID NO: 4070 - RNA, 19 nt, artificial
  Oligomer
aggcccuggagaaugacaa

SEQ ID NO: 4071 - RNA, 19 nt, artificial
  Oligomer
guacaagcuaccggaagug

SEQ ID NO: 4072 - RNA, 19 nt, artificial
  Oligomer
caccgugaccacaucuuua

SEQ ID NO: 4073 - RNA, 19 nt, artificial
  Oligomer
gaccaaaggaaaauaagau

SEQ ID NO: 4074 - RNA, 19 nt, artificial
  Oligomer
cuguuagaauaaaaagccu

SEQ ID NO: 4075 - RNA, 19 nt, artificial
  Oligomer
ucagaaagacagaauuuca

SEQ ID NO: 4076 - RNA, 19 nt, artificial
  Oligomer
aggagcagaacuugagugu

SEQ ID NO: 4077 - RNA, 19 nt, artificial
  Oligomer
ccacuuucuuugacagucc

SEQ ID NO: 4078 - RNA, 19 nt, artificial
  Oligomer
ggaggagcagaacuugagu

SEQ ID NO: 4079 - RNA, 19 nt, artificial
  Oligomer
acaagcuaccggaagugau

SEQ ID NO: 4080 - RNA, 19 nt, artificial
  Oligomer
agaacaccgugaccacauc

SEQ ID NO: 4081 - RNA, 19 nt, artificial
  Oligomer
caaggaccaaaggaaaaua

SEQ ID NO: 4082 - RNA, 19 nt, artificial
  Oligomer
agcaucuucacaaggacca

SEQ ID NO: 4083 - RNA, 19 nt, artificial
  Oligomer
ugucuuaucugccaggaaa

SEQ ID NO: 4084 - RNA, 19 nt, artificial
  Oligomer
cuucagaaagacagaauuu

SEQ ID NO: 4085 - RNA, 19 nt, artificial
  Oligomer
acacuggaaagaaaaagaa

SEQ ID NO: 4086 - RNA, 19 nt, artificial
  Oligomer
gccacguaaugagucaaag

SEQ ID NO: 4087 - RNA, 19 nt, artificial
  Oligomer
ggaaacgccacguaaugag

SEQ ID NO: 4088 - RNA, 19 nt, artificial
  Oligomer
caaggaaacgccacguaau

SEQ ID NO: 4089 - RNA, 19 nt, artificial
  Oligomer
ggaccaaaggaaaauaaga

SEQ ID NO: 4090 - RNA, 19 nt, artificial
  Oligomer
acaaggaccaaaggaaaau

SEQ ID NO: 4091 - RNA, 19 nt, artificial
  Oligomer
gugucuuaucugccaggaa

SEQ ID NO: 4092 - RNA, 19 nt, artificial
  Oligomer
cacuuucuuugacagucca

SEQ ID NO: 4093 - RNA, 19 nt, artificial
  Oligomer
acgaugcggacacuggaaa

SEQ ID NO: 4094 - RNA, 19 nt, artificial
  Oligomer
augguggagaagaaaacuu

SEQ ID NO: 4095 - RNA, 19 nt, artificial
  Oligomer
gcaguuucuuccgacaguu

SEQ ID NO: 4096 - RNA, 19 nt, artificial
  Oligomer
caucuucacaaggaccaaa

SEQ ID NO: 4097 - RNA, 19 nt, artificial
  Oligomer
uguuggaggagcagaacuu

SEQ ID NO: 4098 - RNA, 19 nt, artificial
  Oligomer
ggacacuggaaagaaaaag

SEQ ID NO: 4099 - RNA, 19 nt, artificial
  Oligomer
acgccacguaaugagucaa

SEQ ID NO: 4100 - RNA, 19 nt, artificial
  Oligomer
aaggaccaaaggaaaauaa

SEQ ID NO: 4101 - RNA, 19 nt, artificial
  Oligomer
ucaguuugaugacgaugcg

SEQ ID NO: 4102 - RNA, 19 nt, artificial
  Oligomer
cguaaugagucaaagcugu

SEQ ID NO: 4103 - RNA, 19 nt, artificial
  Oligomer
cacguaaugagucaaagcu

SEQ ID NO: 4104 - RNA, 19 nt, artificial
  Oligomer
ucacaaggaccaaaggaaa

SEQ ID NO: 4105 - RNA, 19 nt, artificial
  Oligomer
gccuuugugaucacagcau

SEQ ID NO: 4106 - RNA, 19 nt, artificial
  Oligomer
gcaagagacugccucaguu

SEQ ID NO: 4107 - RNA, 19 nt, artificial
  Oligomer
cacaaggaccaaaggaaaa

SEQ ID NO: 4108 - RNA, 19 nt, artificial
  Oligomer
ccacguaaugagucaaagc

SEQ ID NO: 4109 - RNA, 19 nt, artificial
  Oligomer
acagaauuucaucacccaa

SEQ ID NO: 4110 - RNA, 19 nt, artificial
  Oligomer
gacacuggaaagaaaaaga

SEQ ID NO: 4111 - RNA, 19 nt, artificial
  Oligomer
ggagaagaaaacuucgguu

SEQ ID NO: 4112 - RNA, 19 nt, artificial
  Oligomer
ccaacaaaacugugucuua

SEQ ID NO: 4113 - RNA, 19 nt, artificial
  Oligomer
ucgcuuccgaaaaaacuuu

SEQ ID NO: 4114 - RNA, 19 nt, artificial
  Oligomer
aaacuucgcuuccgaaaaa

SEQ ID NO: 4115 - RNA, 19 nt, artificial
  Oligomer
cgcgcagaaguacaagcua

SEQ ID NO: 4116 - RNA, 19 nt, artificial
  Oligomer
acaucuuuaaaaugaccca

SEQ ID NO: 4117 - RNA, 19 nt, artificial
  Oligomer
accacaucuuuaaaaugac

SEQ ID NO: 4118 - RNA, 19 nt, artificial
  Oligomer
cccaacaaaacugugucuu

SEQ ID NO: 4119 - RNA, 19 nt, artificial
  Oligomer
cgcucauucacccaacaaa

SEQ ID NO: 4120 - RNA, 19 nt, artificial
  Oligomer
aaaacuuucaggcccuguu

SEQ ID NO: 4121 - RNA, 19 nt, artificial
  Oligomer
cgaaaaaacuuucaggccc

SEQ ID NO: 4122 - RNA, 19 nt, artificial
  Oligomer
gaaguacaagcuaccggaa

SEQ ID NO: 4123 - RNA, 19 nt, artificial
  Oligomer
aacuucgcuuccgaaaaaa

SEQ ID NO: 4124 - RNA, 19 nt, artificial
  Oligomer
agaaguacaagcuaccgga

SEQ ID NO: 4125 - RNA, 19 nt, artificial
  Oligomer
ccacuaggaaccucggauu

SEQ ID NO: 4126 - RNA, 19 nt, artificial
  Oligomer
acaagauuuacaccuccac

SEQ ID NO: 4127 - RNA, 19 nt, artificial
  Oligomer
cacaagauuuacaccucca

SEQ ID NO: 4128 - RNA, 19 nt, artificial
  Oligomer
ggcucccacaagauuuaca

SEQ ID NO: 4129 - RNA, 19 nt, artificial
  Oligomer
ccacaucuuuaaaaugacc

SEQ ID NO: 4130 - RNA, 19 nt, artificial
  Oligomer
cgcuuccgaaaaaacuuuc

SEQ ID NO: 4131 - RNA, 19 nt, artificial
  Oligomer
gagacugccucaguuugau

SEQ ID NO: 4132 - RNA, 19 nt, artificial
  Oligomer
caagagacugccucaguuu

SEQ ID NO: 4133 - RNA, 19 nt, artificial
  Oligomer
uccaaggaaacgccacgua

SEQ ID NO: 4134 - RNA, 19 nt, artificial
  Oligomer
gaccacaucuuuaaaauga

SEQ ID NO: 4135 - RNA, 19 nt, artificial
  Oligomer
ccgcucauucacccaacaa

SEQ ID NO: 4136 - RNA, 19 nt, artificial
  Oligomer
gacagaauuucaucaccca

SEQ ID NO: 4137 - RNA, 19 nt, artificial
  Oligomer
gccuucagaaagacagaau

SEQ ID NO: 4138 - RNA, 19 nt, artificial
  Oligomer
gaaaacccgaggugaucau

SEQ ID NO: 4139 - RNA, 19 nt, artificial
  Oligomer
ggagaaugacaacuuccag

SEQ ID NO: 4140 - RNA, 19 nt, artificial
  Oligomer
caaugguggagaagaaaac

SEQ ID NO: 4141 - RNA, 19 nt, artificial
  Oligomer
gcgcagaaguacaagcuac

SEQ ID NO: 4142 - RNA, 19 nt, artificial
  Oligomer
caacaaaacugugucuuau

SEQ ID NO: 4143 - RNA, 19 nt, artificial
  Oligomer
gcuuccgaaaaaacuuuca

SEQ ID NO: 4144 - RNA, 19 nt, artificial
  Oligomer
cccacaagauuuacaccuc

SEQ ID NO: 4145 - RNA, 19 nt, artificial
  Oligomer
gcucccacaagauuuacac

SEQ ID NO: 4146 - RNA, 19 nt, artificial
  Oligomer
gaaagacagaauuucauca

SEQ ID NO: 4147 - RNA, 19 nt, artificial
  Oligomer
gccucaguuugaugacgau

SEQ ID NO: 4148 - RNA, 19 nt, artificial
  Oligomer
gagaagaaaacuucgguuc

SEQ ID NO: 4149 - RNA, 19 nt, artificial
  Oligomer
caguuguguugugccaaug

SEQ ID NO: 4150 - RNA, 19 nt, artificial
  Oligomer
cgacaguuguguugugcca

SEQ ID NO: 4151 - RNA, 19 nt, artificial
  Oligomer
gcagcaguuucuuccgaca

SEQ ID NO: 4152 - RNA, 19 nt, artificial
  Oligomer
gcuuucuugucuccaagga

SEQ ID NO: 4153 - RNA, 19 nt, artificial
  Oligomer
ccacaagauuuacaccucc

SEQ ID NO: 4154 - RNA, 19 nt, artificial
  Oligomer
caucuuuaaaaugacccau

SEQ ID NO: 4155 - RNA, 19 nt, artificial
  Oligomer
ugaccacaucuuuaaaaug

SEQ ID NO: 4156 - RNA, 19 nt, artificial
  Oligomer
ccuuugugaucacagcauc

SEQ ID NO: 4157 - RNA, 19 nt, artificial
  Oligomer
agacagaauuucaucaccc

SEQ ID NO: 4158 - RNA, 19 nt, artificial
  Oligomer
ggccuucagaaagacagaa

SEQ ID NO: 4159 - RNA, 19 nt, artificial
  Oligomer
ugaugacgaugcggacacu

SEQ ID NO: 4160 - RNA, 19 nt, artificial
  Oligomer
uggagaagaaaacuucggu

SEQ ID NO: 4161 - RNA, 19 nt, artificial
  Oligomer
uugugccaaugguggagaa

SEQ ID NO: 4162 - RNA, 19 nt, artificial
  Oligomer
ccaaggaaacgccacguaa

SEQ ID NO: 4163 - RNA, 19 nt, artificial
  Oligomer
ugaggccggaagugguuuu

SEQ ID NO: 4164 - RNA, 19 nt, artificial
  Oligomer
acaaaacugugucuuaucu

SEQ ID NO: 4165 - RNA, 19 nt, artificial
  Oligomer
cgcagaaguacaagcuacc

SEQ ID NO: 4166 - RNA, 19 nt, artificial
  Oligomer
agauuucuuguaagaacac

SEQ ID NO: 4167 - RNA, 19 nt, artificial
  Oligomer
ucacccaacaaaacugugu

SEQ ID NO: 4168 - RNA, 19 nt, artificial
  Oligomer
cggccuucagaaagacaga

SEQ ID NO: 4169 - RNA, 19 nt, artificial
  Oligomer
gccacuuucuuugacaguc

SEQ ID NO: 4170 - RNA, 19 nt, artificial
  Oligomer
agaaugacaacuuccagga

SEQ ID NO: 4171 - RNA, 19 nt, artificial
  Oligomer
agcaguuucuuccgacagu

SEQ ID NO: 4172 - RNA, 19 nt, artificial
  Oligomer
acgcgcagaaguacaagcu

SEQ ID NO: 4173 - RNA, 19 nt, artificial
  Oligomer
ggaagccagccacuuucuu

SEQ ID NO: 4174 - RNA, 19 nt, artificial
  Oligomer
guggcucccacaagauuua

SEQ ID NO: 4175 - RNA, 19 nt, artificial
  Oligomer
gcuguuagaauaaaaagcc

SEQ ID NO: 4176 - RNA, 19 nt, artificial
  Oligomer
acccaacaaaacugugucu

SEQ ID NO: 4177 - RNA, 19 nt, artificial
  Oligomer
ggugucugaaguggacugu

SEQ ID NO: 4178 - RNA, 19 nt, artificial
  Oligomer
ggcugccuuugugaucaca

SEQ ID NO: 4179 - RNA, 19 nt, artificial
  Oligomer
uggagaaugacaacuucca

SEQ ID NO: 4180 - RNA, 19 nt, artificial
  Oligomer
cagccacuuucuuugacag

SEQ ID NO: 4181 - RNA, 19 nt, artificial
  Oligomer
ccagccacuuucuuugaca

SEQ ID NO: 4182 - RNA, 19 nt, artificial
  Oligomer
ucccacaagauuuacaccu

SEQ ID NO: 4183 - RNA, 19 nt, artificial
  Oligomer
ggaguucagcuuucugcag

SEQ ID NO: 4184 - RNA, 19 nt, artificial
  Oligomer
cacccaacaaaacuguguc

SEQ ID NO: 4185 - RNA, 19 nt, artificial
  Oligomer
ugguggagaagaaaacuuc

SEQ ID NO: 4186 - RNA, 19 nt, artificial
  Oligomer
gccaaugguggagaagaaa

SEQ ID NO: 4187 - RNA, 19 nt, artificial
  Oligomer
ggaacugggaguucagcuu

SEQ ID NO: 4188 - RNA, 19 nt, artificial
  Oligomer
gaagaaaacuucgguucgc

SEQ ID NO: 4189 - RNA, 19 nt, artificial
  Oligomer
gggaguucagcuuucugca

SEQ ID NO: 4190 - RNA, 19 nt, artificial
  Oligomer
ugccucaguuugaugacga

SEQ ID NO: 4191 - RNA, 19 nt, artificial
  Oligomer
gccagccacuuucuuugac

SEQ ID NO: 4192 - RNA, 19 nt, artificial
  Oligomer
gagaccaggugucugaagu

SEQ ID NO: 4193 - RNA, 19 nt, artificial
  Oligomer
cguggcucccacaagauuu

SEQ ID NO: 4194 - RNA, 19 nt, artificial
  Oligomer
gaguucagcuuucugcaga

SEQ ID NO: 4195 - RNA, 19 nt, artificial
  Oligomer
gaacugggaguucagcuuu

SEQ ID NO: 4196 - RNA, 19 nt, artificial
  Oligomer
gaagccagccacuuucuuu

SEQ ID NO: 4197 - RNA, 19 nt, artificial
  Oligomer
ccaaugguggagaagaaaa

SEQ ID NO: 4198 - RNA, 19 nt, artificial
  Oligomer
uuuaaaaugaucaccucgg

SEQ ID NO: 4199 - RNA, 19 nt, artificial
  Oligomer
uuaaaaugaucaccucggg

SEQ ID NO: 4200 - RNA, 19 nt, artificial
  Oligomer
uuuuaaagauguggucacg

SEQ ID NO: 4201 - RNA, 19 nt, artificial
  Oligomer
uucgccauguuuuauaggg

SEQ ID NO: 4202 - RNA, 19 nt, artificial
  Oligomer
auuuuaaagauguggucac

SEQ ID NO: 4203 - RNA, 19 nt, artificial
  Oligomer
agggccugaaaguuuuuuc

SEQ ID NO: 4204 - RNA, 19 nt, artificial
  Oligomer
aaguugucauucuccaggg

SEQ ID NO: 4205 - RNA, 19 nt, artificial
  Oligomer
uuuucgccauguuuuauag

SEQ ID NO: 4206 - RNA, 19 nt, artificial
  Oligomer
uuuaaagauguggucacgg

SEQ ID NO: 4207 - RNA, 19 nt, artificial
  Oligomer
uuaaagauguggucacggu

SEQ ID NO: 4208 - RNA, 19 nt, artificial
  Oligomer
augaaauucugucuuucug

SEQ ID NO: 4209 - RNA, 19 nt, artificial
  Oligomer
uuuuucuuuccaguguccg

SEQ ID NO: 4210 - RNA, 19 nt, artificial
  Oligomer
uuuuauucuaacagcacug

SEQ ID NO: 4211 - RNA, 19 nt, artificial
  Oligomer
uuuuguugggugaaugagc

SEQ ID NO: 4212 - RNA, 19 nt, artificial
  Oligomer
gaagcgaaguuuaaaauga

SEQ ID NO: 4213 - RNA, 19 nt, artificial
  Oligomer
aguuuaaaaugaucaccuc

SEQ ID NO: 4214 - RNA, 19 nt, artificial
  Oligomer
guuuaaaaugaucaccucg

SEQ ID NO: 4215 - RNA, 19 nt, artificial
  Oligomer
uuuucuuuccaguguccgc

SEQ ID NO: 4216 - RNA, 19 nt, artificial
  Oligomer
uuugacucauuacguggcg

SEQ ID NO: 4217 - RNA, 19 nt, artificial
  Oligomer
aauucugucuuucugaagg

SEQ ID NO: 4218 - RNA, 19 nt, artificial
  Oligomer
uuucgccauguuuuauagg

SEQ ID NO: 4219 - RNA, 19 nt, artificial
  Oligomer
guccuugugaagaugcugu

SEQ ID NO: 4220 - RNA, 19 nt, artificial
  Oligomer
uccuugugaagaugcugug

SEQ ID NO: 4221 - RNA, 19 nt, artificial
  Oligomer
uuauucuaacagcacuggg

SEQ ID NO: 4222 - RNA, 19 nt, artificial
  Oligomer
uaaaaugaucaccucgggu

SEQ ID NO: 4223 - RNA, 19 nt, artificial
  Oligomer
aaaaugaucaccucggguu

SEQ ID NO: 4224 - RNA, 19 nt, artificial
  Oligomer
aguugucauucuccagggc

SEQ ID NO: 4225 - RNA, 19 nt, artificial
  Oligomer
aaagauguggucacggugu

SEQ ID NO: 4226 - RNA, 19 nt, artificial
  Oligomer
uugguccuugugaagaugc

SEQ ID NO: 4227 - RNA, 19 nt, artificial
  Oligomer
uugugaagaugcugugauc

SEQ ID NO: 4228 - RNA, 19 nt, artificial
  Oligomer
cacacucaaguucugcucc

SEQ ID NO: 4229 - RNA, 19 nt, artificial
  Oligomer
gcgaaguuuaaaaugauca

SEQ ID NO: 4230 - RNA, 19 nt, artificial
  Oligomer
cgaaguuuaaaaugaucac

SEQ ID NO: 4231 - RNA, 19 nt, artificial
  Oligomer
uucuucuuuuucuuuccag

SEQ ID NO: 4232 - RNA, 19 nt, artificial
  Oligomer
uugucauucuccagggccu

SEQ ID NO: 4233 - RNA, 19 nt, artificial
  Oligomer
cacuuccgguagcuuguac

SEQ ID NO: 4234 - RNA, 19 nt, artificial
  Oligomer
uaaagauguggucacggug

SEQ ID NO: 4235 - RNA, 19 nt, artificial
  Oligomer
aucuuauuuuccuuugguc

SEQ ID NO: 4236 - RNA, 19 nt, artificial
  Oligomer
aggcuuuuuauucuaacag

SEQ ID NO: 4237 - RNA, 19 nt, artificial
  Oligomer
ugaaauucugucuuucuga

SEQ ID NO: 4238 - RNA, 19 nt, artificial
  Oligomer
acacucaaguucugcuccu

SEQ ID NO: 4239 - RNA, 19 nt, artificial
  Oligomer
ggacugucaaagaaagugg

SEQ ID NO: 4240 - RNA, 19 nt, artificial
  Oligomer
acucaaguucugcuccucc

SEQ ID NO: 4241 - RNA, 19 nt, artificial
  Oligomer
aucacuuccgguagcuugu

SEQ ID NO: 4242 - RNA, 19 nt, artificial
  Oligomer
gauguggucacgguguucu

SEQ ID NO: 4243 - RNA, 19 nt, artificial
  Oligomer
uauuuuccuuugguccuug

SEQ ID NO: 4244 - RNA, 19 nt, artificial
  Oligomer
ugguccuugugaagaugcu

SEQ ID NO: 4245 - RNA, 19 nt, artificial
  Oligomer
uuuccuggcagauaagaca

SEQ ID NO: 4246 - RNA, 19 nt, artificial
  Oligomer
aaauucugucuuucugaag

SEQ ID NO: 4247 - RNA, 19 nt, artificial
  Oligomer
uucuuuuucuuuccagugu

SEQ ID NO: 4248 - RNA, 19 nt, artificial
  Oligomer
cuuugacucauuacguggc

SEQ ID NO: 4249 - RNA, 19 nt, artificial
  Oligomer
cucauuacguggcguuucc

SEQ ID NO: 4250 - RNA, 19 nt, artificial
  Oligomer
auuacguggcguuuccuug

SEQ ID NO: 4251 - RNA, 19 nt, artificial
  Oligomer
ucuuauuuuccuuuggucc

SEQ ID NO: 4252 - RNA, 19 nt, artificial
  Oligomer
auuuuccuuugguccuugu

SEQ ID NO: 4253 - RNA, 19 nt, artificial
  Oligomer
uuccuggcagauaagacac

SEQ ID NO: 4254 - RNA, 19 nt, artificial
  Oligomer
uggacugucaaagaaagug

SEQ ID NO: 4255 - RNA, 19 nt, artificial
  Oligomer
uuuccaguguccgcaucgu

SEQ ID NO: 4256 - RNA, 19 nt, artificial
  Oligomer
aaguuuucuucuccaccau

SEQ ID NO: 4257 - RNA, 19 nt, artificial
  Oligomer
aacugucggaagaaacugc

SEQ ID NO: 4258 - RNA, 19 nt, artificial
  Oligomer
uuugguccuugugaagaug

SEQ ID NO: 4259 - RNA, 19 nt, artificial
  Oligomer
aaguucugcuccuccaaca

SEQ ID NO: 4260 - RNA, 19 nt, artificial
  Oligomer
cuuuuucuuuccagugucc

SEQ ID NO: 4261 - RNA, 19 nt, artificial
  Oligomer
uugacucauuacguggcgu

SEQ ID NO: 4262 - RNA, 19 nt, artificial
  Oligomer
uuauuuuccuuugguccuu

SEQ ID NO: 4263 - RNA, 19 nt, artificial
  Oligomer
cgcaucgucaucaaacuga

SEQ ID NO: 4264 - RNA, 19 nt, artificial
  Oligomer
acagcuuugacucauuacg

SEQ ID NO: 4265 - RNA, 19 nt, artificial
  Oligomer
agcuuugacucauuacgug

SEQ ID NO: 4266 - RNA, 19 nt, artificial
  Oligomer
uuuccuuugguccuuguga

SEQ ID NO: 4267 - RNA, 19 nt, artificial
  Oligomer
augcugugaucacaaaggc

SEQ ID NO: 4268 - RNA, 19 nt, artificial
  Oligomer
aacugaggcagucucuugc

SEQ ID NO: 4269 - RNA, 19 nt, artificial
  Oligomer
uuuuccuuugguccuugug

SEQ ID NO: 4270 - RNA, 19 nt, artificial
  Oligomer
gcuuugacucauuacgugg

SEQ ID NO: 4271 - RNA, 19 nt, artificial
  Oligomer
uugggugaugaaauucugu

SEQ ID NO: 4272 - RNA, 19 nt, artificial
  Oligomer
ucuuuuucuuuccaguguc

SEQ ID NO: 4273 - RNA, 19 nt, artificial
  Oligomer
aaccgaaguuuucuucucc

SEQ ID NO: 4274 - RNA, 19 nt, artificial
  Oligomer
uaagacacaguuuuguugg

SEQ ID NO: 4275 - RNA, 19 nt, artificial
  Oligomer
aaaguuuuuucggaagcga

SEQ ID NO: 4276 - RNA, 19 nt, artificial
  Oligomer
uuuuucggaagcgaaguuu

SEQ ID NO: 4277 - RNA, 19 nt, artificial
  Oligomer
uagcuuguacuucugcgcg

SEQ ID NO: 4278 - RNA, 19 nt, artificial
  Oligomer
ugggucauuuuaaagaugu

SEQ ID NO: 4279 - RNA, 19 nt, artificial
  Oligomer
gucauuuuaaagauguggu

SEQ ID NO: 4280 - RNA, 19 nt, artificial
  Oligomer
aagacacaguuuuguuggg

SEQ ID NO: 4281 - RNA, 19 nt, artificial
  Oligomer
uuuguugggugaaugagcg

SEQ ID NO: 4282 - RNA, 19 nt, artificial
  Oligomer
aacagggccugaaaguuuu

SEQ ID NO: 4283 - RNA, 19 nt, artificial
  Oligomer
gggccugaaaguuuuuucg

SEQ ID NO: 4284 - RNA, 19 nt, artificial
  Oligomer
uuccgguagcuuguacuuc

SEQ ID NO: 4285 - RNA, 19 nt, artificial
  Oligomer
uuuuuucggaagcgaaguu

SEQ ID NO: 4286 - RNA, 19 nt, artificial
  Oligomer
uccgguagcuuguacuucu

SEQ ID NO: 4287 - RNA, 19 nt, artificial
  Oligomer
aauccgagguuccuagugg

SEQ ID NO: 4288 - RNA, 19 nt, artificial
  Oligomer
guggagguguaaaucuugu

SEQ ID NO: 4289 - RNA, 19 nt, artificial
  Oligomer
uggagguguaaaucuugug

SEQ ID NO: 4290 - RNA, 19 nt, artificial
  Oligomer
uguaaaucuugugggagcc

SEQ ID NO: 4291 - RNA, 19 nt, artificial
  Oligomer
ggucauuuuaaagaugugg

SEQ ID NO: 4292 - RNA, 19 nt, artificial
  Oligomer
gaaaguuuuuucggaagcg

SEQ ID NO: 4293 - RNA, 19 nt, artificial
  Oligomer
aucaaacugaggcagucuc

SEQ ID NO: 4294 - RNA, 19 nt, artificial
  Oligomer
aaacugaggcagucucuug

SEQ ID NO: 4295 - RNA, 19 nt, artificial
  Oligomer
uacguggcguuuccuugga

SEQ ID NO: 4296 - RNA, 19 nt, artificial
  Oligomer
ucauuuuaaagaugugguc

SEQ ID NO: 4297 - RNA, 19 nt, artificial
  Oligomer
uuguugggugaaugagcgg

SEQ ID NO: 4298 - RNA, 19 nt, artificial
  Oligomer
ugggugaugaaauucuguc

SEQ ID NO: 4299 - RNA, 19 nt, artificial
  Oligomer
auucugucuuucugaaggc

SEQ ID NO: 4300 - RNA, 19 nt, artificial
  Oligomer
augaucaccucggguuuuc

SEQ ID NO: 4301 - RNA, 19 nt, artificial
  Oligomer
cuggaaguugucauucucc

SEQ ID NO: 4302 - RNA, 19 nt, artificial
  Oligomer
guuuucuucuccaccauug

SEQ ID NO: 4303 - RNA, 19 nt, artificial
  Oligomer
guagcuuguacuucugcgc

SEQ ID NO: 4304 - RNA, 19 nt, artificial
  Oligomer
auaagacacaguuuuguug

SEQ ID NO: 4305 - RNA, 19 nt, artificial
  Oligomer
ugaaaguuuuuucggaagc

SEQ ID NO: 4306 - RNA, 19 nt, artificial
  Oligomer
gagguguaaaucuuguggg

SEQ ID NO: 4307 - RNA, 19 nt, artificial
  Oligomer
guguaaaucuugugggagc

SEQ ID NO: 4308 - RNA, 19 nt, artificial
  Oligomer
ugaugaaauucugucuuuc

SEQ ID NO: 4309 - RNA, 19 nt, artificial
  Oligomer
aucgucaucaaacugaggc

SEQ ID NO: 4310 - RNA, 19 nt, artificial
  Oligomer
gaaccgaaguuuucuucuc

SEQ ID NO: 4311 - RNA, 19 nt, artificial
  Oligomer
cauuggcacaacacaacug

SEQ ID NO: 4312 - RNA, 19 nt, artificial
  Oligomer
uggcacaacacaacugucg

SEQ ID NO: 4313 - RNA, 19 nt, artificial
  Oligomer
ugucggaagaaacugcugc

SEQ ID NO: 4314 - RNA, 19 nt, artificial
  Oligomer
uccuuggagacaagaaagc

SEQ ID NO: 4315 - RNA, 19 nt, artificial
  Oligomer
ggagguguaaaucuugugg

SEQ ID NO: 4316 - RNA, 19 nt, artificial
  Oligomer
augggucauuuuaaagaug

SEQ ID NO: 4317 - RNA, 19 nt, artificial
  Oligomer
cauuuuaaagaugugguca

SEQ ID NO: 4318 - RNA, 19 nt, artificial
  Oligomer
gaugcugugaucacaaagg

SEQ ID NO: 4319 - RNA, 19 nt, artificial
  Oligomer
gggugaugaaauucugucu

SEQ ID NO: 4320 - RNA, 19 nt, artificial
  Oligomer
uucugucuuucugaaggcc

SEQ ID NO: 4321 - RNA, 19 nt, artificial
  Oligomer
aguguccgcaucgucauca

SEQ ID NO: 4322 - RNA, 19 nt, artificial
  Oligomer
accgaaguuuucuucucca

SEQ ID NO: 4323 - RNA, 19 nt, artificial
  Oligomer
uucuccaccauuggcacaa

SEQ ID NO: 4324 - RNA, 19 nt, artificial
  Oligomer
uuacguggcguuuccuugg

SEQ ID NO: 4325 - RNA, 19 nt, artificial
  Oligomer
aaaaccacuuccggccuca

SEQ ID NO: 4326 - RNA, 19 nt, artificial
  Oligomer
agauaagacacaguuuugu

SEQ ID NO: 4327 - RNA, 19 nt, artificial
  Oligomer
gguagcuuguacuucugcg

SEQ ID NO: 4328 - RNA, 19 nt, artificial
  Oligomer
guguucuuacaagaaaucu

SEQ ID NO: 4329 - RNA, 19 nt, artificial
  Oligomer
acacaguuuuguuggguga

SEQ ID NO: 4330 - RNA, 19 nt, artificial
  Oligomer
ucugucuuucugaaggccg

SEQ ID NO: 4331 - RNA, 19 nt, artificial
  Oligomer
gacugucaaagaaaguggc

SEQ ID NO: 4332 - RNA, 19 nt, artificial
  Oligomer
uccuggaaguugucauucu

SEQ ID NO: 4333 - RNA, 19 nt, artificial
  Oligomer
acugucggaagaaacugcu

SEQ ID NO: 4334 - RNA, 19 nt, artificial
  Oligomer
agcuuguacuucugcgcgu

SEQ ID NO: 4335 - RNA, 19 nt, artificial
  Oligomer
aagaaaguggcuggcuucc

SEQ ID NO: 4336 - RNA, 19 nt, artificial
  Oligomer
uaaaucuugugggagccac

SEQ ID NO: 4337 - RNA, 19 nt, artificial
  Oligomer
ggcuuuuuauucuaacagc

SEQ ID NO: 4338 - RNA, 19 nt, artificial
  Oligomer
agacacaguuuuguugggu

SEQ ID NO: 4339 - RNA, 19 nt, artificial
  Oligomer
acaguccacuucagacacc

SEQ ID NO: 4340 - RNA, 19 nt, artificial
  Oligomer
ugugaucacaaaggcagcc

SEQ ID NO: 4341 - RNA, 19 nt, artificial
  Oligomer
uggaaguugucauucucca

SEQ ID NO: 4342 - RNA, 19 nt, artificial
  Oligomer
cugucaaagaaaguggcug

SEQ ID NO: 4343 - RNA, 19 nt, artificial
  Oligomer
ugucaaagaaaguggcugg

SEQ ID NO: 4344 - RNA, 19 nt, artificial
  Oligomer
agguguaaaucuuguggga

SEQ ID NO: 4345 - RNA, 19 nt, artificial
  Oligomer
cugcagaaagcugaacucc

SEQ ID NO: 4346 - RNA, 19 nt, artificial
  Oligomer
gacacaguuuuguugggug

SEQ ID NO: 4347 - RNA, 19 nt, artificial
  Oligomer
gaaguuuucuucuccacca

SEQ ID NO: 4348 - RNA, 19 nt, artificial
  Oligomer
uuucuucuccaccauuggc

SEQ ID NO: 4349 - RNA, 19 nt, artificial
  Oligomer
aagcugaacucccaguucc

SEQ ID NO: 4350 - RNA, 19 nt, artificial
  Oligomer
gcgaaccgaaguuuucuuc

SEQ ID NO: 4351 - RNA, 19 nt, artificial
  Oligomer
ugcagaaagcugaacuccc

SEQ ID NO: 4352 - RNA, 19 nt, artificial
  Oligomer
ucgucaucaaacugaggca

SEQ ID NO: 4353 - RNA, 19 nt, artificial
  Oligomer
gucaaagaaaguggcuggc

SEQ ID NO: 4354 - RNA, 19 nt, artificial
  Oligomer
acuucagacaccuggucuc

SEQ ID NO: 4355 - RNA, 19 nt, artificial
  Oligomer
aaaucuugugggagccacg

SEQ ID NO: 4356 - RNA, 19 nt, artificial
  Oligomer
ucugcagaaagcugaacuc

SEQ ID NO: 4357 - RNA, 19 nt, artificial
  Oligomer
aaagcugaacucccaguuc

SEQ ID NO: 4358 - RNA, 19 nt, artificial
  Oligomer
aaagaaaguggcuggcuuc

SEQ ID NO: 4359 - RNA, 19 nt, artificial
  Oligomer
uuuucuucuccaccauugg

SEQ ID NO: 4360 - RNA, 21 nt, artificial
  Oligomer
ccgugaccacaucuuuaaaau

SEQ ID NO: 4361 - RNA, 21 nt, artificial
  Oligomer
cgaggugaucauuuuaaacuu

SEQ ID NO: 4362 - RNA, 21 nt, artificial
  Oligomer
ccagugcuguuagaauaaaaa

SEQ ID NO: 4363 - RNA, 21 nt, artificial
  Oligomer
cccagugcuguuagaauaaaa

SEQ ID NO: 4364 - RNA, 21 nt, artificial
  Oligomer
cccgaggugaucauuuuaaac

SEQ ID NO: 4365 - RNA, 21 nt, artificial
  Oligomer
acccgaggugaucauuuuaaa

SEQ ID NO: 4366 - RNA, 21 nt, artificial
  Oligomer
ccuauaaaacauggcgaaaag

SEQ ID NO: 4367 - RNA, 21 nt, artificial
  Oligomer
cccuauaaaacauggcgaaaa

SEQ ID NO: 4368 - RNA, 21 nt, artificial
  Oligomer
caccgugaccacaucuuuaaa

SEQ ID NO: 4369 - RNA, 21 nt, artificial
  Oligomer
ggcccuggagaaugacaacuu

SEQ ID NO: 4370 - RNA, 21 nt, artificial
  Oligomer
ggaccaaaggaaaauaagauu

SEQ ID NO: 4371 - RNA, 21 nt, artificial
  Oligomer
gaaugacaacuuccaggauga

SEQ ID NO: 4372 - RNA, 21 nt, artificial
  Oligomer
gaacaccgugaccacaucuuu

SEQ ID NO: 4373 - RNA, 21 nt, artificial
  Oligomer
ucacagcaucuucacaaggac

SEQ ID NO: 4374 - RNA, 21 nt, artificial
  Oligomer
ggaggagcagaacuugagugu

SEQ ID NO: 4375 - RNA, 21 nt, artificial
  Oligomer
aaacccgaggugaucauuuua

SEQ ID NO: 4376 - RNA, 21 nt, artificial
  Oligomer
accgugaccacaucuuuaaaa

SEQ ID NO: 4377 - RNA, 21 nt, artificial
  Oligomer
acaccgugaccacaucuuuaa

SEQ ID NO: 4378 - RNA, 21 nt, artificial
  Oligomer
gaggugaucauuuuaaacuuc

SEQ ID NO: 4379 - RNA, 21 nt, artificial
  Oligomer
ccgaggugaucauuuuaaacu

SEQ ID NO: 4380 - RNA, 21 nt, artificial
  Oligomer
cgaugcggacacuggaaagaa

SEQ ID NO: 4381 - RNA, 21 nt, artificial
  Oligomer
gcccuggagaaugacaacuuc

SEQ ID NO: 4382 - RNA, 21 nt, artificial
  Oligomer
gcaucuucacaaggaccaaag

SEQ ID NO: 4383 - RNA, 21 nt, artificial
  Oligomer
cagcaucuucacaaggaccaa

SEQ ID NO: 4384 - RNA, 21 nt, artificial
  Oligomer
gugaucauuuuaaacuucgcu

SEQ ID NO: 4385 - RNA, 21 nt, artificial
  Oligomer
ucauucacccaacaaaacugu

SEQ ID NO: 4386 - RNA, 21 nt, artificial
  Oligomer
ggugaucauuuuaaacuucgc

SEQ ID NO: 4387 - RNA, 21 nt, artificial
  Oligomer
ggacacuggaaagaaaaagaa

SEQ ID NO: 4388 - RNA, 21 nt, artificial
  Oligomer
ccacuuucuuugacaguccag

SEQ ID NO: 4389 - RNA, 21 nt, artificial
  Oligomer
guacaagcuaccggaagugau

SEQ ID NO: 4390 - RNA, 21 nt, artificial
  Oligomer
gcucauucacccaacaaaacu

SEQ ID NO: 4391 - RNA, 21 nt, artificial
  Oligomer
ggaaagaaaaagaagaaaacc

SEQ ID NO: 4392 - RNA, 21 nt, artificial
  Oligomer
ugcggacacuggaaagaaaaa

SEQ ID NO: 4393 - RNA, 21 nt, artificial
  Oligomer
cuauaaaacauggcgaaaagc

SEQ ID NO: 4394 - RNA, 21 nt, artificial
  Oligomer
cagugcuguuagaauaaaaag

SEQ ID NO: 4395 - RNA, 21 nt, artificial
  Oligomer
cuucagaaagacagaauuuca

SEQ ID NO: 4396 - RNA, 21 nt, artificial
  Oligomer
cacuggaaagaaaaagaagaa

SEQ ID NO: 4397 - RNA, 21 nt, artificial
  Oligomer
augcggacacuggaaagaaaa

SEQ ID NO: 4398 - RNA, 21 nt, artificial
  Oligomer
agaacaccgugaccacaucuu

SEQ ID NO: 4399 - RNA, 21 nt, artificial
  Oligomer
ccacguaaugagucaaagcug

SEQ ID NO: 4400 - RNA, 21 nt, artificial
  Oligomer
guaagaacaccgugaccacau

SEQ ID NO: 4401 - RNA, 21 nt, artificial
  Oligomer
acaaggaccaaaggaaaauaa

SEQ ID NO: 4402 - RNA, 21 nt, artificial
  Oligomer
gugucuuaucugccaggaaag

SEQ ID NO: 4403 - RNA, 21 nt, artificial
  Oligomer
cacaaggaccaaaggaaaaua

SEQ ID NO: 4404 - RNA, 21 nt, artificial
  Oligomer
cggacacuggaaagaaaaaga

SEQ ID NO: 4405 - RNA, 21 nt, artificial
  Oligomer
aggaccaaaggaaaauaagau

SEQ ID NO: 4406 - RNA, 21 nt, artificial
  Oligomer
cuucacaaggaccaaaggaaa

SEQ ID NO: 4407 - RNA, 21 nt, artificial
  Oligomer
acguaaugagucaaagcugug

SEQ ID NO: 4408 - RNA, 21 nt, artificial
  Oligomer
caaggaccaaaggaaaauaag

SEQ ID NO: 4409 - RNA, 21 nt, artificial
  Oligomer
ucacaaggaccaaaggaaaau

SEQ ID NO: 4410 - RNA, 21 nt, artificial
  Oligomer
acgccacguaaugagucaaag

SEQ ID NO: 4411 - RNA, 21 nt, artificial
  Oligomer
aggaaacgccacguaaugagu

SEQ ID NO: 4412 - RNA, 21 nt, artificial
  Oligomer
gaauuucaucacccaaugcag

SEQ ID NO: 4413 - RNA, 21 nt, artificial
  Oligomer
agacagaauuucaucacccaa

SEQ ID NO: 4414 - RNA, 21 nt, artificial
  Oligomer
caguuugaugacgaugcggac

SEQ ID NO: 4415 - RNA, 21 nt, artificial
  Oligomer
cagcaguuucuuccgacaguu

SEQ ID NO: 4416 - RNA, 21 nt, artificial
  Oligomer
gacacuggaaagaaaaagaag

SEQ ID NO: 4417 - RNA, 21 nt, artificial
  Oligomer
ccgaaaaaacuuucaggcccu

SEQ ID NO: 4418 - RNA, 21 nt, artificial
  Oligomer
gcggacacuggaaagaaaaag

SEQ ID NO: 4419 - RNA, 21 nt, artificial
  Oligomer
ccacaagauuuacaccuccac

SEQ ID NO: 4420 - RNA, 21 nt, artificial
  Oligomer
cgaaaaaacuuucaggcccug

SEQ ID NO: 4421 - RNA, 21 nt, artificial
  Oligomer
gcaguuucuuccgacaguugu

SEQ ID NO: 4422 - RNA, 21 nt, artificial
  Oligomer
ugaccacaucuuuaaaaugac

SEQ ID NO: 4423 - RNA, 21 nt, artificial
  Oligomer
ccgcucauucacccaacaaaa

SEQ ID NO: 4424 - RNA, 21 nt, artificial
  Oligomer
acagaauuucaucacccaaug

SEQ ID NO: 4425 - RNA, 21 nt, artificial
  Oligomer
gacagaauuucaucacccaau

SEQ ID NO: 4426 - RNA, 21 nt, artificial
  Oligomer
agaaagacagaauuucaucac

SEQ ID NO: 4427 - RNA, 21 nt, artificial
  Oligomer
uaaacuucgcuuccgaaaaaa

SEQ ID NO: 4428 - RNA, 21 nt, artificial
  Oligomer
agcaguuucuuccgacaguug

SEQ ID NO: 4429 - RNA, 21 nt, artificial
  Oligomer
cccacaagauuuacaccucca

SEQ ID NO: 4430 - RNA, 21 nt, artificial
  Oligomer
cggccuucagaaagacagaau

SEQ ID NO: 4431 - RNA, 21 nt, artificial
  Oligomer
ggagaaugacaacuuccagga

SEQ ID NO: 4432 - RNA, 21 nt, artificial
  Oligomer
acccaacaaaacugugucuua

SEQ ID NO: 4433 - RNA, 21 nt, artificial
  Oligomer
ggcaagagacugccucaguuu

SEQ ID NO: 4434 - RNA, 21 nt, artificial
  Oligomer
ccacaucuuuaaaaugaccca

SEQ ID NO: 4435 - RNA, 21 nt, artificial
  Oligomer
gccuucagaaagacagaauuu

SEQ ID NO: 4436 - RNA, 21 nt, artificial
  Oligomer
ucgcuuccgaaaaaacuuuca

SEQ ID NO: 4437 - RNA, 21 nt, artificial
  Oligomer
uuaaacuucgcuuccgaaaaa

SEQ ID NO: 4438 - RNA, 21 nt, artificial
  Oligomer
caaugguggagaagaaaacuu

SEQ ID NO: 4439 - RNA, 21 nt, artificial
  Oligomer
gaaguacaagcuaccggaagu

SEQ ID NO: 4440 - RNA, 21 nt, artificial
  Oligomer
gcagaaguacaagcuaccgga

SEQ ID NO: 4441 - RNA, 21 nt, artificial
  Oligomer
agcuuucuugucuccaaggaa

SEQ ID NO: 4442 - RNA, 21 nt, artificial
  Oligomer
cacaagauuuacaccuccaca

SEQ ID NO: 4443 - RNA, 21 nt, artificial
  Oligomer
cagaauuucaucacccaaugc

SEQ ID NO: 4444 - RNA, 21 nt, artificial
  Oligomer
ccuuugugaucacagcaucuu

SEQ ID NO: 4445 - RNA, 21 nt, artificial
  Oligomer
gccuuugugaucacagcaucu

SEQ ID NO: 4446 - RNA, 21 nt, artificial
  Oligomer
gaaaaaacuuucaggcccugu

SEQ ID NO: 4447 - RNA, 21 nt, artificial
  Oligomer
agaaaacccgaggugaucauu

SEQ ID NO: 4448 - RNA, 21 nt, artificial
  Oligomer
ggagaagaaaacuucgguucg

SEQ ID NO: 4449 - RNA, 21 nt, artificial
  Oligomer
cagaaguacaagcuaccggaa

SEQ ID NO: 4450 - RNA, 21 nt, artificial
  Oligomer
cgugaccacaucuuuaaaaug

SEQ ID NO: 4451 - RNA, 21 nt, artificial
  Oligomer
ccaacaaaacugugucuuauc

SEQ ID NO: 4452 - RNA, 21 nt, artificial
  Oligomer
cacccaacaaaacugugucuu

SEQ ID NO: 4453 - RNA, 21 nt, artificial
  Oligomer
ggccuucagaaagacagaauu

SEQ ID NO: 4454 - RNA, 21 nt, artificial
  Oligomer
cgcuuccgaaaaaacuuucag

SEQ ID NO: 4455 - RNA, 21 nt, artificial
  Oligomer
ugacgaugcggacacuggaaa

SEQ ID NO: 4456 - RNA, 21 nt, artificial
  Oligomer
gugccaaugguggagaagaaa

SEQ ID NO: 4457 - RNA, 21 nt, artificial
  Oligomer
cuccaaggaaacgccacguaa

SEQ ID NO: 4458 - RNA, 21 nt, artificial
  Oligomer
caagauuuacaccuccacacu

SEQ ID NO: 4459 - RNA, 21 nt, artificial
  Oligomer
cacaucuuuaaaaugacccau

SEQ ID NO: 4460 - RNA, 21 nt, artificial
  Oligomer
gugaucacagcaucuucacaa

SEQ ID NO: 4461 - RNA, 21 nt, artificial
  Oligomer
gccgcucauucacccaacaaa

SEQ ID NO: 4462 - RNA, 21 nt, artificial
  Oligomer
ucagaaagacagaauuucauc

SEQ ID NO: 4463 - RNA, 21 nt, artificial
  Oligomer
cugccucaguuugaugacgau

SEQ ID NO: 4464 - RNA, 21 nt, artificial
  Oligomer
gcaagagacugccucaguuug

SEQ ID NO: 4465 - RNA, 21 nt, artificial
  Oligomer
guggagaagaaaacuucgguu

SEQ ID NO: 4466 - RNA, 21 nt, artificial
  Oligomer
gacaguuguguugugccaaug

SEQ ID NO: 4467 - RNA, 21 nt, artificial
  Oligomer
cuuuaaaaugacccauuucgu

SEQ ID NO: 4468 - RNA, 21 nt, artificial
  Oligomer
agccgcucauucacccaacaa

SEQ ID NO: 4469 - RNA, 21 nt, artificial
  Oligomer
cauuuuaaacuucgcuuccga

SEQ ID NO: 4470 - RNA, 21 nt, artificial
  Oligomer
gagaaugacaacuuccaggau

SEQ ID NO: 4471 - RNA, 21 nt, artificial
  Oligomer
gguggagaagaaaacuucggu

SEQ ID NO: 4472 - RNA, 21 nt, artificial
  Oligomer
ccgacaguuguguugugccaa

SEQ ID NO: 4473 - RNA, 21 nt, artificial
  Oligomer
gcuuucuugucuccaaggaaa

SEQ ID NO: 4474 - RNA, 21 nt, artificial
  Oligomer
gggaacugggaguucagcuuu

SEQ ID NO: 4475 - RNA, 21 nt, artificial
  Oligomer
cccaacaaaacugugucuuau

SEQ ID NO: 4476 - RNA, 21 nt, artificial
  Oligomer
cgcucauucacccaacaaaac

SEQ ID NO: 4477 - RNA, 21 nt, artificial
  Oligomer
gaaaacccgaggugaucauuu

SEQ ID NO: 4478 - RNA, 21 nt, artificial
  Oligomer
uggagaagaaaacuucgguuc

SEQ ID NO: 4479 - RNA, 21 nt, artificial
  Oligomer
uguugugccaaugguggagaa

SEQ ID NO: 4480 - RNA, 21 nt, artificial
  Oligomer
cgacaguuguguugugccaau

SEQ ID NO: 4481 - RNA, 21 nt, artificial
  Oligomer
uccaaggaaacgccacguaau

SEQ ID NO: 4482 - RNA, 21 nt, artificial
  Oligomer
uggcucccacaagauuuacac

SEQ ID NO: 4483 - RNA, 21 nt, artificial
  Oligomer
ugaucacagcaucuucacaag

SEQ ID NO: 4484 - RNA, 21 nt, artificial
  Oligomer
ugccuuugugaucacagcauc

SEQ ID NO: 4485 - RNA, 21 nt, artificial
  Oligomer
acaguuguguugugccaaugg

SEQ ID NO: 4486 - RNA, 21 nt, artificial
  Oligomer
gccagccacuuucuuugacag

SEQ ID NO: 4487 - RNA, 21 nt, artificial
  Oligomer
cacgcgcagaaguacaagcua

SEQ ID NO: 4488 - RNA, 21 nt, artificial
  Oligomer
gcuguuagaauaaaaagccuc

SEQ ID NO: 4489 - RNA, 21 nt, artificial
  Oligomer
agagacugccucaguuugaug

SEQ ID NO: 4490 - RNA, 21 nt, artificial
  Oligomer
gccacuuucuuugacagucca

SEQ ID NO: 4491 - RNA, 21 nt, artificial
  Oligomer
agaagaaaacuucgguucgcu

SEQ ID NO: 4492 - RNA, 21 nt, artificial
  Oligomer
ugcuguuagaauaaaaagccu

SEQ ID NO: 4493 - RNA, 21 nt, artificial
  Oligomer
cugugucuuaucugccaggaa

SEQ ID NO: 4494 - RNA, 21 nt, artificial
  Oligomer
ucacccaacaaaacugugucu

SEQ ID NO: 4495 - RNA, 21 nt, artificial
  Oligomer
gugucugaaguggacugugug

SEQ ID NO: 4496 - RNA, 21 nt, artificial
  Oligomer
caggugucugaaguggacugu

SEQ ID NO: 4497 - RNA, 21 nt, artificial
  Oligomer
ccuguuggaggagcagaacuu

SEQ ID NO: 4498 - RNA, 21 nt, artificial
  Oligomer
gcugccuuugugaucacagca

SEQ ID NO: 4499 - RNA, 21 nt, artificial
  Oligomer
cccuggagaaugacaacuucc

SEQ ID NO: 4500 - RNA, 21 nt, artificial
  Oligomer
ccagccacuuucuuugacagu

SEQ ID NO: 4501 - RNA, 21 nt, artificial
  Oligomer
gcagcaguuucuuccgacagu

SEQ ID NO: 4502 - RNA, 21 nt, artificial
  Oligomer
ccaaggaaacgccacguaaug

SEQ ID NO: 4503 - RNA, 21 nt, artificial
  Oligomer
agauuuacaccuccacacuga

SEQ ID NO: 4504 - RNA, 21 nt, artificial
  Oligomer
cugccuuugugaucacagcau

SEQ ID NO: 4505 - RNA, 21 nt, artificial
  Oligomer
agacugccucaguuugaugac

SEQ ID NO: 4506 - RNA, 21 nt, artificial
  Oligomer
cuggagaaugacaacuuccag

SEQ ID NO: 4507 - RNA, 21 nt, artificial
  Oligomer
gaagaaaacuucgguucgcuc

SEQ ID NO: 4508 - RNA, 21 nt, artificial
  Oligomer
guuucuuccgacaguuguguu

SEQ ID NO: 4509 - RNA, 21 nt, artificial
  Oligomer
cucccacaagauuuacaccuc

SEQ ID NO: 4510 - RNA, 21 nt, artificial
  Oligomer
ggaguucagcuuucugcagag

SEQ ID NO: 4511 - RNA, 21 nt, artificial
  Oligomer
caacaaaacugugucuuaucu

SEQ ID NO: 4512 - RNA, 21 nt, artificial
  Oligomer
cguggcucccacaagauuuac

SEQ ID NO: 4513 - RNA, 21 nt, artificial
  Oligomer
ucguggcucccacaagauuua

SEQ ID NO: 4514 - RNA, 21 nt, artificial
  Oligomer
ccggccuucagaaagacagaa

SEQ ID NO: 4515 - RNA, 21 nt, artificial
  Oligomer
ugaaguggacugugugagccu

SEQ ID NO: 4516 - RNA, 21 nt, artificial
  Oligomer
cgccacguaaugagucaaagc

SEQ ID NO: 4517 - RNA, 21 nt, artificial
  Oligomer
ucuccaaggaaacgccacgua

SEQ ID NO: 4518 - RNA, 21 nt, artificial
  Oligomer
acggaagccagccacuuucuu

SEQ ID NO: 4519 - RNA, 21 nt, artificial
  Oligomer
ggaacugggaguucagcuuuc

SEQ ID NO: 4520 - RNA, 21 nt, artificial
  Oligomer
cugggaguucagcuuucugca

SEQ ID NO: 4521 - RNA, 21 nt, artificial
  Oligomer
ggaagccagccacuuucuuug

SEQ ID NO: 4522 - RNA, 21 nt, artificial
  Oligomer
cggaagccagccacuuucuuu

SEQ ID NO: 4523 - RNA, 21 nt, artificial
  Oligomer
ccucaguuugaugacgaugcg

SEQ ID NO: 4524 - RNA, 21 nt, artificial
  Oligomer
agccacuuucuuugacagucc

SEQ ID NO: 4525 - RNA, 21 nt, artificial
  Oligomer
agccagccacuuucuuugaca

SEQ ID NO: 4526 - RNA, 21 nt, artificial
  Oligomer
ugccucaguuugaugacgaug

SEQ ID NO: 4527 - RNA, 21 nt, artificial
  Oligomer
gaacugggaguucagcuuucu

SEQ ID NO: 4528 - RNA, 21 nt, artificial
  Oligomer
gccacguaaugagucaaagcu

SEQ ID NO: 4529 - RNA, 21 nt, artificial
  Oligomer
gaagccagccacuuucuuuga

SEQ ID NO: 4530 - RNA, 21 nt, artificial
  Oligomer
gggaguucagcuuucugcaga

SEQ ID NO: 4531 - RNA, 21 nt, artificial
  Oligomer
ugccaaugguggagaagaaaa

SEQ ID NO: 4532 - RNA, 21 nt, artificial
  Oligomer
ccaaugguggagaagaaaacu

SEQ ID NO: 4533 - RNA, 21 nt, artificial
  Oligomer
gccaaugguggagaagaaaac

SEQ ID NO: 4534 - RNA, 21 nt, artificial
  Oligomer
agaccaggugucugaagugga

SEQ ID NO: 4535 - RNA, 21 nt, artificial
  Oligomer
auuuuaaagauguggucacgg

SEQ ID NO: 4536 - RNA, 21 nt, artificial
  Oligomer
aaguuuaaaaugaucaccucg

SEQ ID NO: 4537 - RNA, 21 nt, artificial
  Oligomer
uuuuuauucuaacagcacugg

SEQ ID NO: 4538 - RNA, 21 nt, artificial
  Oligomer
uuuuauucuaacagcacuggg

SEQ ID NO: 4539 - RNA, 21 nt, artificial
  Oligomer
guuuaaaaugaucaccucggg

SEQ ID NO: 4540 - RNA, 21 nt, artificial
  Oligomer
uuuaaaaugaucaccucgggu

SEQ ID NO: 4541 - RNA, 21 nt, artificial
  Oligomer
cuuuucgccauguuuuauagg

SEQ ID NO: 4542 - RNA, 21 nt, artificial
  Oligomer
uuuucgccauguuuuauaggg

SEQ ID NO: 4543 - RNA, 21 nt, artificial
  Oligomer
uuuaaagauguggucacggug

SEQ ID NO: 4544 - RNA, 21 nt, artificial
  Oligomer
aaguugucauucuccagggcc

SEQ ID NO: 4545 - RNA, 21 nt, artificial
  Oligomer
aaucuuauuuuccuuuggucc

SEQ ID NO: 4546 - RNA, 21 nt, artificial
  Oligomer
ucauccuggaaguugucauuc

SEQ ID NO: 4547 - RNA, 21 nt, artificial
  Oligomer
aaagauguggucacgguguuc

SEQ ID NO: 4548 - RNA, 21 nt, artificial
  Oligomer
guccuugugaagaugcuguga

SEQ ID NO: 4549 - RNA, 21 nt, artificial
  Oligomer
acacucaaguucugcuccucc

SEQ ID NO: 4550 - RNA, 21 nt, artificial
  Oligomer
uaaaaugaucaccucggguuu

SEQ ID NO: 4551 - RNA, 21 nt, artificial
  Oligomer
uuuuaaagauguggucacggu

SEQ ID NO: 4552 - RNA, 21 nt, artificial
  Oligomer
uuaaagauguggucacggugu

SEQ ID NO: 4553 - RNA, 21 nt, artificial
  Oligomer
gaaguuuaaaaugaucaccuc

SEQ ID NO: 4554 - RNA, 21 nt, artificial
  Oligomer
aguuuaaaaugaucaccucgg

SEQ ID NO: 4555 - RNA, 21 nt, artificial
  Oligomer
uucuuuccaguguccgcaucg

SEQ ID NO: 4556 - RNA, 21 nt, artificial
  Oligomer
gaaguugucauucuccagggc

SEQ ID NO: 4557 - RNA, 21 nt, artificial
  Oligomer
cuuugguccuugugaagaugc

SEQ ID NO: 4558 - RNA, 21 nt, artificial
  Oligomer
uugguccuugugaagaugcug

SEQ ID NO: 4559 - RNA, 21 nt, artificial
  Oligomer
agcgaaguuuaaaaugaucac

SEQ ID NO: 4560 - RNA, 21 nt, artificial
  Oligomer
acaguuuuguugggugaauga

SEQ ID NO: 4561 - RNA, 21 nt, artificial
  Oligomer
gcgaaguuuaaaaugaucacc

SEQ ID NO: 4562 - RNA, 21 nt, artificial
  Oligomer
uucuuuuucuuuccagugucc

SEQ ID NO: 4563 - RNA, 21 nt, artificial
  Oligomer
cuggacugucaaagaaagugg

SEQ ID NO: 4564 - RNA, 21 nt, artificial
  Oligomer
aucacuuccgguagcuuguac

SEQ ID NO: 4565 - RNA, 21 nt, artificial
  Oligomer
aguuuuguugggugaaugagc

SEQ ID NO: 4566 - RNA, 21 nt, artificial
  Oligomer
gguuuucuucuuuuucuuucc

SEQ ID NO: 4567 - RNA, 21 nt, artificial
  Oligomer
uuuuucuuuccaguguccgca

SEQ ID NO: 4568 - RNA, 21 nt, artificial
  Oligomer
gcuuuucgccauguuuuauag

SEQ ID NO: 4569 - RNA, 21 nt, artificial
  Oligomer
cuuuuuauucuaacagcacug

SEQ ID NO: 4570 - RNA, 21 nt, artificial
  Oligomer
ugaaauucugucuuucugaag

SEQ ID NO: 4571 - RNA, 21 nt, artificial
  Oligomer
uucuucuuuuucuuuccagug

SEQ ID NO: 4572 - RNA, 21 nt, artificial
  Oligomer
uuuucuuuccaguguccgcau

SEQ ID NO: 4573 - RNA, 21 nt, artificial
  Oligomer
aagauguggucacgguguucu

SEQ ID NO: 4574 - RNA, 21 nt, artificial
  Oligomer
cagcuuugacucauuacgugg

SEQ ID NO: 4575 - RNA, 21 nt, artificial
  Oligomer
auguggucacgguguucuuac

SEQ ID NO: 4576 - RNA, 21 nt, artificial
  Oligomer
uuauuuuccuuugguccuugu

SEQ ID NO: 4577 - RNA, 21 nt, artificial
  Oligomer
cuuuccuggcagauaagacac

SEQ ID NO: 4578 - RNA, 21 nt, artificial
  Oligomer
uauuuuccuuugguccuugug

SEQ ID NO: 4579 - RNA, 21 nt, artificial
  Oligomer
ucuuuuucuuuccaguguccg

SEQ ID NO: 4580 - RNA, 21 nt, artificial
  Oligomer
aucuuauuuuccuuugguccu

SEQ ID NO: 4581 - RNA, 21 nt, artificial
  Oligomer
uuuccuuugguccuugugaag

SEQ ID NO: 4582 - RNA, 21 nt, artificial
  Oligomer
cacagcuuugacucauuacgu

SEQ ID NO: 4583 - RNA, 21 nt, artificial
  Oligomer
cuuauuuuccuuugguccuug

SEQ ID NO: 4584 - RNA, 21 nt, artificial
  Oligomer
auuuuccuuugguccuuguga

SEQ ID NO: 4585 - RNA, 21 nt, artificial
  Oligomer
cuuugacucauuacguggcgu

SEQ ID NO: 4586 - RNA, 21 nt, artificial
  Oligomer
acucauuacguggcguuuccu

SEQ ID NO: 4587 - RNA, 21 nt, artificial
  Oligomer
cugcauugggugaugaaauuc

SEQ ID NO: 4588 - RNA, 21 nt, artificial
  Oligomer
uugggugaugaaauucugucu

SEQ ID NO: 4589 - RNA, 21 nt, artificial
  Oligomer
guccgcaucgucaucaaacug

SEQ ID NO: 4590 - RNA, 21 nt, artificial
  Oligomer
aacugucggaagaaacugcug

SEQ ID NO: 4591 - RNA, 21 nt, artificial
  Oligomer
cuucuuuuucuuuccaguguc

SEQ ID NO: 4592 - RNA, 21 nt, artificial
  Oligomer
agggccugaaaguuuuuucgg

SEQ ID NO: 4593 - RNA, 21 nt, artificial
  Oligomer
cuuuuucuuuccaguguccgc

SEQ ID NO: 4594 - RNA, 21 nt, artificial
  Oligomer
guggagguguaaaucuugugg

SEQ ID NO: 4595 - RNA, 21 nt, artificial
  Oligomer
cagggccugaaaguuuuuucg

SEQ ID NO: 4596 - RNA, 21 nt, artificial
  Oligomer
acaacugucggaagaaacugc

SEQ ID NO: 4597 - RNA, 21 nt, artificial
  Oligomer
gucauuuuaaagaugugguca

SEQ ID NO: 4598 - RNA, 21 nt, artificial
  Oligomer
uuuuguugggugaaugagcgg

SEQ ID NO: 4599 - RNA, 21 nt, artificial
  Oligomer
cauugggugaugaaauucugu

SEQ ID NO: 4600 - RNA, 21 nt, artificial
  Oligomer
auugggugaugaaauucuguc

SEQ ID NO: 4601 - RNA, 21 nt, artificial
  Oligomer
gugaugaaauucugucuuucu

SEQ ID NO: 4602 - RNA, 21 nt, artificial
  Oligomer
uuuuuucggaagcgaaguuua

SEQ ID NO: 4603 - RNA, 21 nt, artificial
  Oligomer
caacugucggaagaaacugcu

SEQ ID NO: 4604 - RNA, 21 nt, artificial
  Oligomer
uggagguguaaaucuuguggg

SEQ ID NO: 4605 - RNA, 21 nt, artificial
  Oligomer
auucugucuuucugaaggccg

SEQ ID NO: 4606 - RNA, 21 nt, artificial
  Oligomer
uccuggaaguugucauucucc

SEQ ID NO: 4607 - RNA, 21 nt, artificial
  Oligomer
uaagacacaguuuuguugggu

SEQ ID NO: 4608 - RNA, 21 nt, artificial
  Oligomer
aaacugaggcagucucuugcc

SEQ ID NO: 4609 - RNA, 21 nt, artificial
  Oligomer
ugggucauuuuaaagaugugg

SEQ ID NO: 4610 - RNA, 21 nt, artificial
  Oligomer
aaauucugucuuucugaaggc

SEQ ID NO: 4611 - RNA, 21 nt, artificial
  Oligomer
ugaaaguuuuuucggaagcga

SEQ ID NO: 4612 - RNA, 21 nt, artificial
  Oligomer
uuuuucggaagcgaaguuuaa

SEQ ID NO: 4613 - RNA, 21 nt, artificial
  Oligomer
aaguuuucuucuccaccauug

SEQ ID NO: 4614 - RNA, 21 nt, artificial
  Oligomer
acuuccgguagcuuguacuuc

SEQ ID NO: 4615 - RNA, 21 nt, artificial
  Oligomer
uccgguagcuuguacuucugc

SEQ ID NO: 4616 - RNA, 21 nt, artificial
  Oligomer
uuccuuggagacaagaaagcu

SEQ ID NO: 4617 - RNA, 21 nt, artificial
  Oligomer
uguggagguguaaaucuugug

SEQ ID NO: 4618 - RNA, 21 nt, artificial
  Oligomer
gcauugggugaugaaauucug

SEQ ID NO: 4619 - RNA, 21 nt, artificial
  Oligomer
aagaugcugugaucacaaagg

SEQ ID NO: 4620 - RNA, 21 nt, artificial
  Oligomer
agaugcugugaucacaaaggc

SEQ ID NO: 4621 - RNA, 21 nt, artificial
  Oligomer
acagggccugaaaguuuuuuc

SEQ ID NO: 4622 - RNA, 21 nt, artificial
  Oligomer
aaugaucaccucggguuuucu

SEQ ID NO: 4623 - RNA, 21 nt, artificial
  Oligomer
cgaaccgaaguuuucuucucc

SEQ ID NO: 4624 - RNA, 21 nt, artificial
  Oligomer
uuccgguagcuuguacuucug

SEQ ID NO: 4625 - RNA, 21 nt, artificial
  Oligomer
cauuuuaaagauguggucacg

SEQ ID NO: 4626 - RNA, 21 nt, artificial
  Oligomer
gauaagacacaguuuuguugg

SEQ ID NO: 4627 - RNA, 21 nt, artificial
  Oligomer
aagacacaguuuuguugggug

SEQ ID NO: 4628 - RNA, 21 nt, artificial
  Oligomer
aauucugucuuucugaaggcc

SEQ ID NO: 4629 - RNA, 21 nt, artificial
  Oligomer
cugaaaguuuuuucggaagcg

SEQ ID NO: 4630 - RNA, 21 nt, artificial
  Oligomer
uuuccaguguccgcaucguca

SEQ ID NO: 4631 - RNA, 21 nt, artificial
  Oligomer
uuucuucuccaccauuggcac

SEQ ID NO: 4632 - RNA, 21 nt, artificial
  Oligomer
uuacguggcguuuccuuggag

SEQ ID NO: 4633 - RNA, 21 nt, artificial
  Oligomer
aguguggagguguaaaucuug

SEQ ID NO: 4634 - RNA, 21 nt, artificial
  Oligomer
augggucauuuuaaagaugug

SEQ ID NO: 4635 - RNA, 21 nt, artificial
  Oligomer
uugugaagaugcugugaucac

SEQ ID NO: 4636 - RNA, 21 nt, artificial
  Oligomer
uuuguugggugaaugagcggc

SEQ ID NO: 4637 - RNA, 21 nt, artificial
  Oligomer
gaugaaauucugucuuucuga

SEQ ID NO: 4638 - RNA, 21 nt, artificial
  Oligomer
aucgucaucaaacugaggcag

SEQ ID NO: 4639 - RNA, 21 nt, artificial
  Oligomer
caaacugaggcagucucuugc

SEQ ID NO: 4640 - RNA, 21 nt, artificial
  Oligomer
aaccgaaguuuucuucuccac

SEQ ID NO: 4641 - RNA, 21 nt, artificial
  Oligomer
cauuggcacaacacaacuguc

SEQ ID NO: 4642 - RNA, 21 nt, artificial
  Oligomer
acgaaaugggucauuuuaaag

SEQ ID NO: 4643 - RNA, 21 nt, artificial
  Oligomer
uuguugggugaaugagcggcu

SEQ ID NO: 4644 - RNA, 21 nt, artificial
  Oligomer
ucggaagcgaaguuuaaaaug

SEQ ID NO: 4645 - RNA, 21 nt, artificial
  Oligomer
auccuggaaguugucauucuc

SEQ ID NO: 4646 - RNA, 21 nt, artificial
  Oligomer
accgaaguuuucuucuccacc

SEQ ID NO: 4647 - RNA, 21 nt, artificial
  Oligomer
uuggcacaacacaacugucgg

SEQ ID NO: 4648 - RNA, 21 nt, artificial
  Oligomer
uuuccuuggagacaagaaagc

SEQ ID NO: 4649 - RNA, 21 nt, artificial
  Oligomer
aaagcugaacucccaguuccc

SEQ ID NO: 4650 - RNA, 21 nt, artificial
  Oligomer
auaagacacaguuuuguuggg

SEQ ID NO: 4651 - RNA, 21 nt, artificial
  Oligomer
guuuuguugggugaaugagcg

SEQ ID NO: 4652 - RNA, 21 nt, artificial
  Oligomer
aaaugaucaccucggguuuuc

SEQ ID NO: 4653 - RNA, 21 nt, artificial
  Oligomer
gaaccgaaguuuucuucucca

SEQ ID NO: 4654 - RNA, 21 nt, artificial
  Oligomer
uucuccaccauuggcacaaca

SEQ ID NO: 4655 - RNA, 21 nt, artificial
  Oligomer
auuggcacaacacaacugucg

SEQ ID NO: 4656 - RNA, 21 nt, artificial
  Oligomer
auuacguggcguuuccuugga

SEQ ID NO: 4657 - RNA, 21 nt, artificial
  Oligomer
guguaaaucuugugggagcca

SEQ ID NO: 4658 - RNA, 21 nt, artificial
  Oligomer
cuugugaagaugcugugauca

SEQ ID NO: 4659 - RNA, 21 nt, artificial
  Oligomer
gaugcugugaucacaaaggca

SEQ ID NO: 4660 - RNA, 21 nt, artificial
  Oligomer
ccauuggcacaacacaacugu

SEQ ID NO: 4661 - RNA, 21 nt, artificial
  Oligomer
cugucaaagaaaguggcuggc

SEQ ID NO: 4662 - RNA, 21 nt, artificial
  Oligomer
uagcuuguacuucugcgcgug

SEQ ID NO: 4663 - RNA, 21 nt, artificial
  Oligomer
gaggcuuuuuauucuaacagc

SEQ ID NO: 4664 - RNA, 21 nt, artificial
  Oligomer
caucaaacugaggcagucucu

SEQ ID NO: 4665 - RNA, 21 nt, artificial
  Oligomer
uggacugucaaagaaaguggc

SEQ ID NO: 4666 - RNA, 21 nt, artificial
  Oligomer
agcgaaccgaaguuuucuucu

SEQ ID NO: 4667 - RNA, 21 nt, artificial
  Oligomer
aggcuuuuuauucuaacagca

SEQ ID NO: 4668 - RNA, 21 nt, artificial
  Oligomer
uuccuggcagauaagacacag

SEQ ID NO: 4669 - RNA, 21 nt, artificial
  Oligomer
agacacaguuuuguuggguga

SEQ ID NO: 4670 - RNA, 21 nt, artificial
  Oligomer
cacacaguccacuucagacac

SEQ ID NO: 4671 - RNA, 21 nt, artificial
  Oligomer
acaguccacuucagacaccug

SEQ ID NO: 4672 - RNA, 21 nt, artificial
  Oligomer
aaguucugcuccuccaacagg

SEQ ID NO: 4673 - RNA, 21 nt, artificial
  Oligomer
ugcugugaucacaaaggcagc

SEQ ID NO: 4674 - RNA, 21 nt, artificial
  Oligomer
ggaaguugucauucuccaggg

SEQ ID NO: 4675 - RNA, 21 nt, artificial
  Oligomer
acugucaaagaaaguggcugg

SEQ ID NO: 4676 - RNA, 21 nt, artificial
  Oligomer
acugucggaagaaacugcugc

SEQ ID NO: 4677 - RNA, 21 nt, artificial
  Oligomer
cauuacguggcguuuccuugg

SEQ ID NO: 4678 - RNA, 21 nt, artificial
  Oligomer
ucaguguggagguguaaaucu

SEQ ID NO: 4679 - RNA, 21 nt, artificial
  Oligomer
augcugugaucacaaaggcag

SEQ ID NO: 4680 - RNA, 21 nt, artificial
  Oligomer
gucaucaaacugaggcagucu

SEQ ID NO: 4681 - RNA, 21 nt, artificial
  Oligomer
cuggaaguugucauucuccag

SEQ ID NO: 4682 - RNA, 21 nt, artificial
  Oligomer
gagcgaaccgaaguuuucuuc

SEQ ID NO: 4683 - RNA, 21 nt, artificial
  Oligomer
aacacaacugucggaagaaac

SEQ ID NO: 4684 - RNA, 21 nt, artificial
  Oligomer
gagguguaaaucuugugggag

SEQ ID NO: 4685 - RNA, 21 nt, artificial
  Oligomer
cucugcagaaagcugaacucc

SEQ ID NO: 4686 - RNA, 21 nt, artificial
  Oligomer
agauaagacacaguuuuguug

SEQ ID NO: 4687 - RNA, 21 nt, artificial
  Oligomer
guaaaucuugugggagccacg

SEQ ID NO: 4688 - RNA, 21 nt, artificial
  Oligomer
uaaaucuugugggagccacga

SEQ ID NO: 4689 - RNA, 21 nt, artificial
  Oligomer
uucugucuuucugaaggccgg

SEQ ID NO: 4690 - RNA, 21 nt, artificial
  Oligomer
aggcucacacaguccacuuca

SEQ ID NO: 4691 - RNA, 21 nt, artificial
  Oligomer
gcuuugacucauuacguggcg

SEQ ID NO: 4692 - RNA, 21 nt, artificial
  Oligomer
uacguggcguuuccuuggaga

SEQ ID NO: 4693 - RNA, 21 nt, artificial
  Oligomer
aagaaaguggcuggcuuccgu

SEQ ID NO: 4694 - RNA, 21 nt, artificial
  Oligomer
gaaagcugaacucccaguucc

SEQ ID NO: 4695 - RNA, 21 nt, artificial
  Oligomer
ugcagaaagcugaacucccag

SEQ ID NO: 4696 - RNA, 21 nt, artificial
  Oligomer
caaagaaaguggcuggcuucc

SEQ ID NO: 4697 - RNA, 21 nt, artificial
  Oligomer
aaagaaaguggcuggcuuccg

SEQ ID NO: 4698 - RNA, 21 nt, artificial
  Oligomer
cgcaucgucaucaaacugagg

SEQ ID NO: 4699 - RNA, 21 nt, artificial
  Oligomer
ggacugucaaagaaaguggcu

SEQ ID NO: 4700 - RNA, 21 nt, artificial
  Oligomer
ugucaaagaaaguggcuggcu

SEQ ID NO: 4701 - RNA, 21 nt, artificial
  Oligomer
caucgucaucaaacugaggca

SEQ ID NO: 4702 - RNA, 21 nt, artificial
  Oligomer
agaaagcugaacucccaguuc

SEQ ID NO: 4703 - RNA, 21 nt, artificial
  Oligomer
agcuuugacucauuacguggc

SEQ ID NO: 4704 - RNA, 21 nt, artificial
  Oligomer
ucaaagaaaguggcuggcuuc

SEQ ID NO: 4705 - RNA, 21 nt, artificial
  Oligomer
ucugcagaaagcugaacuccc

SEQ ID NO: 4706 - RNA, 21 nt, artificial
  Oligomer
uuuucuucuccaccauuggca

SEQ ID NO: 4707 - RNA, 21 nt, artificial
  Oligomer
aguuuucuucuccaccauugg

SEQ ID NO: 4708 - RNA, 21 nt, artificial
  Oligomer
guuuucuucuccaccauuggc

SEQ ID NO: 4709 - RNA, 21 nt, artificial
  Oligomer
uccacuucagacaccuggucu

SEQ ID NO: 4710 - RNA, 19 nt, artificial
  Oligomer
ugccuuauaaccugccuuu

SEQ ID NO: 4711 - RNA, 19 nt, artificial
  Oligomer
caauacaaagcuggauaau

SEQ ID NO: 4712 - RNA, 19 nt, artificial
  Oligomer
gugccuuauaaccugccuu

SEQ ID NO: 4713 - RNA, 19 nt, artificial
  Oligomer
gggaauuucuggugacaua

SEQ ID NO: 4714 - RNA, 19 nt, artificial
  Oligomer
acauucaucaauaucccuc

SEQ ID NO: 4715 - RNA, 19 nt, artificial
  Oligomer
caaaauacaaguacugguu

SEQ ID NO: 4716 - RNA, 19 nt, artificial
  Oligomer
ccauucaaaauacaaguac

SEQ ID NO: 4717 - RNA, 19 nt, artificial
  Oligomer
ggaagaaagacagucgguu

SEQ ID NO: 4718 - RNA, 19 nt, artificial
  Oligomer
ggaaaauggcagacaauuu

SEQ ID NO: 4719 - RNA, 19 nt, artificial
  Oligomer
ccaugauauaaucugaaag

SEQ ID NO: 4720 - RNA, 19 nt, artificial
  Oligomer
gcaguacaaucaucggguu

SEQ ID NO: 4721 - RNA, 19 nt, artificial
  Oligomer
gagagucauuguuugcaau

SEQ ID NO: 4722 - RNA, 19 nt, artificial
  Oligomer
gaaaauggcagacaauuuu

SEQ ID NO: 4723 - RNA, 19 nt, artificial
  Oligomer
gcguuaucugggucuggaa

SEQ ID NO: 4724 - RNA, 19 nt, artificial
  Oligomer
ggguuaaaaaacucaauga

SEQ ID NO: 4725 - RNA, 19 nt, artificial
  Oligomer
cggguuaaaaaacucaaug

SEQ ID NO: 4726 - RNA, 19 nt, artificial
  Oligomer
ucaaaauacaaguacuggu

SEQ ID NO: 4727 - RNA, 19 nt, artificial
  Oligomer
caagguugcagugaaugau

SEQ ID NO: 4728 - RNA, 19 nt, artificial
  Oligomer
ucuaaaccuuacaugugua

SEQ ID NO: 4729 - RNA, 19 nt, artificial
  Oligomer
ccagugcuucauauaccau

SEQ ID NO: 4730 - RNA, 19 nt, artificial
  Oligomer
gaccucaccagugcuucau

SEQ ID NO: 4731 - RNA, 19 nt, artificial
  Oligomer
cuuuaacccacgcuucaau

SEQ ID NO: 4732 - RNA, 19 nt, artificial
  Oligomer
uccacuuuaacccacgcuu

SEQ ID NO: 4733 - RNA, 19 nt, artificial
  Oligomer
gccuuccacuuuaacccac

SEQ ID NO: 4734 - RNA, 19 nt, artificial
  Oligomer
cguuaucugggucuggaaa

SEQ ID NO: 4735 - RNA, 19 nt, artificial
  Oligomer
accucaccagugcuucaua

SEQ ID NO: 4736 - RNA, 19 nt, artificial
  Oligomer
aagaaagacagucgguuuu

SEQ ID NO: 4737 - RNA, 19 nt, artificial
  Oligomer
gggaagaaagacagucggu

SEQ ID NO: 4738 - RNA, 19 nt, artificial
  Oligomer
ccacuuuaacccacgcuuc

SEQ ID NO: 4739 - RNA, 19 nt, artificial
  Oligomer
ccucgcaugcugauaacaa

SEQ ID NO: 4740 - RNA, 19 nt, artificial
  Oligomer
acauguguaaagguuucau

SEQ ID NO: 4741 - RNA, 19 nt, artificial
  Oligomer
cucaccagugcuucauaua

SEQ ID NO: 4742 - RNA, 19 nt, artificial
  Oligomer
ggaauuucuggugacauag

SEQ ID NO: 4743 - RNA, 19 nt, artificial
  Oligomer
ugggaauuucuggugacau

SEQ ID NO: 4744 - RNA, 19 nt, artificial
  Oligomer
acaaucaucggguuaaaaa

SEQ ID NO: 4745 - RNA, 19 nt, artificial
  Oligomer
gccuuauaaccugccuuug

SEQ ID NO: 4746 - RNA, 19 nt, artificial
  Oligomer
ugcguuaucugggucugga

SEQ ID NO: 4747 - RNA, 19 nt, artificial
  Oligomer
cccucuuguaagucaucua

SEQ ID NO: 4748 - RNA, 19 nt, artificial
  Oligomer
accagugcuucauauacca

SEQ ID NO: 4749 - RNA, 19 nt, artificial
  Oligomer
cugggaauuucuggugaca

SEQ ID NO: 4750 - RNA, 19 nt, artificial
  Oligomer
caaucaucggguuaaaaaa

SEQ ID NO: 4751 - RNA, 19 nt, artificial
  Oligomer
ugauaacaauucugggcac

SEQ ID NO: 4752 - RNA, 19 nt, artificial
  Oligomer
ucgcaugcugauaacaauu

SEQ ID NO: 4753 - RNA, 19 nt, artificial
  Oligomer
gccucgcaugcugauaaca

SEQ ID NO: 4754 - RNA, 19 nt, artificial
  Oligomer
gaauuucuggugacauaga

SEQ ID NO: 4755 - RNA, 19 nt, artificial
  Oligomer
ucaucggguuaaaaaacuc

SEQ ID NO: 4756 - RNA, 19 nt, artificial
  Oligomer
aguacaaucaucggguuaa

SEQ ID NO: 4757 - RNA, 19 nt, artificial
  Oligomer
aggagagucauuguuugca

SEQ ID NO: 4758 - RNA, 19 nt, artificial
  Oligomer
cagugcuucauauaccaug

SEQ ID NO: 4759 - RNA, 19 nt, artificial
  Oligomer
caguacaaucaucggguua

SEQ ID NO: 4760 - RNA, 19 nt, artificial
  Oligomer
caauucugggcacggugaa

SEQ ID NO: 4761 - RNA, 19 nt, artificial
  Oligomer
guaaagguuucauguucac

SEQ ID NO: 4762 - RNA, 19 nt, artificial
  Oligomer
gucauuguuugcaauacaa

SEQ ID NO: 4763 - RNA, 19 nt, artificial
  Oligomer
cugauaacaauucugggca

SEQ ID NO: 4764 - RNA, 19 nt, artificial
  Oligomer
gguuucauguucacuguga

SEQ ID NO: 4765 - RNA, 19 nt, artificial
  Oligomer
ugcaguacaaucaucgggu

SEQ ID NO: 4766 - RNA, 19 nt, artificial
  Oligomer
ugcaauacaaagcuggaua

SEQ ID NO: 4767 - RNA, 19 nt, artificial
  Oligomer
cacgcuucaaugagaacaa

SEQ ID NO: 4768 - RNA, 19 nt, artificial
  Oligomer
uguaaagguuucauguuca

SEQ ID NO: 4769 - RNA, 19 nt, artificial
  Oligomer
uguguaaagguuucauguu

SEQ ID NO: 4770 - RNA, 19 nt, artificial
  Oligomer
gggaagggaagaaagacag

SEQ ID NO: 4771 - RNA, 19 nt, artificial
  Oligomer
uugcaauacaaagcuggau

SEQ ID NO: 4772 - RNA, 19 nt, artificial
  Oligomer
agaauugcuuuagauuucc

SEQ ID NO: 4773 - RNA, 19 nt, artificial
  Oligomer
gcuucauauaccaugauau

SEQ ID NO: 4774 - RNA, 19 nt, artificial
  Oligomer
ugcuucauauaccaugaua

SEQ ID NO: 4775 - RNA, 19 nt, artificial
  Oligomer
cuucaagguugcagugaau

SEQ ID NO: 4776 - RNA, 19 nt, artificial
  Oligomer
ucaaugagaacaacaggag

SEQ ID NO: 4777 - RNA, 19 nt, artificial
  Oligomer
ccacgcuucaaugagaaca

SEQ ID NO: 4778 - RNA, 19 nt, artificial
  Oligomer
ucccucuuguaagucaucu

SEQ ID NO: 4779 - RNA, 19 nt, artificial
  Oligomer
acuucaagguugcagugaa

SEQ ID NO: 4780 - RNA, 19 nt, artificial
  Oligomer
acagucgguuuucccauuu

SEQ ID NO: 4781 - RNA, 19 nt, artificial
  Oligomer
cgcuucaaugagaacaaca

SEQ ID NO: 4782 - RNA, 19 nt, artificial
  Oligomer
acgcuucaaugagaacaac

SEQ ID NO: 4783 - RNA, 19 nt, artificial
  Oligomer
ggaaugauguugccuucca

SEQ ID NO: 4784 - RNA, 19 nt, artificial
  Oligomer
ucuuguaagucaucuacuu

SEQ ID NO: 4785 - RNA, 19 nt, artificial
  Oligomer
agucauuguuugcaauaca

SEQ ID NO: 4786 - RNA, 19 nt, artificial
  Oligomer
gcuucaaugagaacaacag

SEQ ID NO: 4787 - RNA, 19 nt, artificial
  Oligomer
acccacgcuucaaugagaa

SEQ ID NO: 4788 - RNA, 19 nt, artificial
  Oligomer
gagggaaugauguugccuu

SEQ ID NO: 4789 - RNA, 19 nt, artificial
  Oligomer
ugaagcccaaugcaaacag

SEQ ID NO: 4790 - RNA, 19 nt, artificial
  Oligomer
cucaaugaaaucagcaaac

SEQ ID NO: 4791 - RNA, 19 nt, artificial
  Oligomer
cccauuugaaagugggaaa

SEQ ID NO: 4792 - RNA, 19 nt, artificial
  Oligomer
acggugaagcccaaugcaa

SEQ ID NO: 4793 - RNA, 19 nt, artificial
  Oligomer
gccacugauugugccuuau

SEQ ID NO: 4794 - RNA, 19 nt, artificial
  Oligomer
ccucuuguaagucaucuac

SEQ ID NO: 4795 - RNA, 19 nt, artificial
  Oligomer
cuaaaccuuacauguguaa

SEQ ID NO: 4796 - RNA, 19 nt, artificial
  Oligomer
gugcuucauauaccaugau

SEQ ID NO: 4797 - RNA, 19 nt, artificial
  Oligomer
cagucgguuuucccauuug

SEQ ID NO: 4798 - RNA, 19 nt, artificial
  Oligomer
ggaaacccaaacccucaag

SEQ ID NO: 4799 - RNA, 19 nt, artificial
  Oligomer
cucacuuguugcaguacaa

SEQ ID NO: 4800 - RNA, 19 nt, artificial
  Oligomer
agagucauuguuugcaaua

SEQ ID NO: 4801 - RNA, 19 nt, artificial
  Oligomer
auguugccuuccacuuuaa

SEQ ID NO: 4802 - RNA, 19 nt, artificial
  Oligomer
ucggguuaaaaaacucaau

SEQ ID NO: 4803 - RNA, 19 nt, artificial
  Oligomer
ccacuucaagguugcagug

SEQ ID NO: 4804 - RNA, 19 nt, artificial
  Oligomer
ccauuugaaagugggaaac

SEQ ID NO: 4805 - RNA, 19 nt, artificial
  Oligomer
gguuuucccauuugaaagu

SEQ ID NO: 4806 - RNA, 19 nt, artificial
  Oligomer
gucgguuuucccauuugaa

SEQ ID NO: 4807 - RNA, 19 nt, artificial
  Oligomer
gagucauuguuugcaauac

SEQ ID NO: 4808 - RNA, 19 nt, artificial
  Oligomer
gaaugauguugccuuccac

SEQ ID NO: 4809 - RNA, 19 nt, artificial
  Oligomer
gcuuuagauuuccaaagag

SEQ ID NO: 4810 - RNA, 19 nt, artificial
  Oligomer
ugcuuuagauuuccaaaga

SEQ ID NO: 4811 - RNA, 19 nt, artificial
  Oligomer
cucgcaugcugauaacaau

SEQ ID NO: 4812 - RNA, 19 nt, artificial
  Oligomer
ccaucuucuggacagccaa

SEQ ID NO: 4813 - RNA, 19 nt, artificial
  Oligomer
uggaaacccaaacccucaa

SEQ ID NO: 4814 - RNA, 19 nt, artificial
  Oligomer
gaaaucagcaaacugggaa

SEQ ID NO: 4815 - RNA, 19 nt, artificial
  Oligomer
gcucacuuguugcaguaca

SEQ ID NO: 4816 - RNA, 19 nt, artificial
  Oligomer
cagugaaugaugcucacuu

SEQ ID NO: 4817 - RNA, 19 nt, artificial
  Oligomer
cccacgcuucaaugagaac

SEQ ID NO: 4818 - RNA, 19 nt, artificial
  Oligomer
agauuuccaaagagggaau

SEQ ID NO: 4819 - RNA, 19 nt, artificial
  Oligomer
gcaaacagaauugcuuuag

SEQ ID NO: 4820 - RNA, 19 nt, artificial
  Oligomer
cccaaugcaaacagaauug

SEQ ID NO: 4821 - RNA, 19 nt, artificial
  Oligomer
ccuuacauguguaaagguu

SEQ ID NO: 4822 - RNA, 19 nt, artificial
  Oligomer
agucgguuuucccauuuga

SEQ ID NO: 4823 - RNA, 19 nt, artificial
  Oligomer
cgcaugcugauaacaauuc

SEQ ID NO: 4824 - RNA, 19 nt, artificial
  Oligomer
ugccucgcaugcugauaac

SEQ ID NO: 4825 - RNA, 19 nt, artificial
  Oligomer
cuacccaucuucuggacag

SEQ ID NO: 4826 - RNA, 19 nt, artificial
  Oligomer
cuggugacauagaccucac

SEQ ID NO: 4827 - RNA, 19 nt, artificial
  Oligomer
gcagugaaugaugcucacu

SEQ ID NO: 4828 - RNA, 19 nt, artificial
  Oligomer
accacuucaagguugcagu

SEQ ID NO: 4829 - RNA, 19 nt, artificial
  Oligomer
ugcaaacagaauugcuuua

SEQ ID NO: 4830 - RNA, 19 nt, artificial
  Oligomer
aaaucagcaaacugggaau

SEQ ID NO: 4831 - RNA, 19 nt, artificial
  Oligomer
ugcagugaaugaugcucac

SEQ ID NO: 4832 - RNA, 19 nt, artificial
  Oligomer
ccugaccacuucaagguug

SEQ ID NO: 4833 - RNA, 19 nt, artificial
  Oligomer
ucccauuugaaagugggaa

SEQ ID NO: 4834 - RNA, 19 nt, artificial
  Oligomer
agacagucgguuuucccau

SEQ ID NO: 4835 - RNA, 19 nt, artificial
  Oligomer
caacaggagagucauuguu

SEQ ID NO: 4836 - RNA, 19 nt, artificial
  Oligomer
agggaaugauguugccuuc

SEQ ID NO: 4837 - RNA, 19 nt, artificial
  Oligomer
ccaaugcaaacagaauugc

SEQ ID NO: 4838 - RNA, 19 nt, artificial
  Oligomer
agcccaaugcaaacagaau

SEQ ID NO: 4839 - RNA, 19 nt, artificial
  Oligomer
uguucacugugagugaaaa

SEQ ID NO: 4840 - RNA, 19 nt, artificial
  Oligomer
ugaugcguuaucugggucu

SEQ ID NO: 4841 - RNA, 19 nt, artificial
  Oligomer
aaaccuuacauguguaaag

SEQ ID NO: 4842 - RNA, 19 nt, artificial
  Oligomer
gugacauagaccucaccag

SEQ ID NO: 4843 - RNA, 19 nt, artificial
  Oligomer
ucagcaaacugggaauuuc

SEQ ID NO: 4844 - RNA, 19 nt, artificial
  Oligomer
gguugaaccugaccacuuc

SEQ ID NO: 4845 - RNA, 19 nt, artificial
  Oligomer
ugguugaaccugaccacuu

SEQ ID NO: 4846 - RNA, 19 nt, artificial
  Oligomer
gugggaaaccauucaaaau

SEQ ID NO: 4847 - RNA, 19 nt, artificial
  Oligomer
ucgguuuucccauuugaaa

SEQ ID NO: 4848 - RNA, 19 nt, artificial
  Oligomer
ugggucuggaaacccaaac

SEQ ID NO: 4849 - RNA, 19 nt, artificial
  Oligomer
cagugaauuaccugucuca

SEQ ID NO: 4850 - RNA, 19 nt, artificial
  Oligomer
acagugaauuaccugucuc

SEQ ID NO: 4851 - RNA, 19 nt, artificial
  Oligomer
aucggguuaaaaaacucaa

SEQ ID NO: 4852 - RNA, 19 nt, artificial
  Oligomer
auagaccucaccagugcuu

SEQ ID NO: 4853 - RNA, 19 nt, artificial
  Oligomer
agugaaugaugcucacuug

SEQ ID NO: 4854 - RNA, 19 nt, artificial
  Oligomer
accugaccacuucaagguu

SEQ ID NO: 4855 - RNA, 19 nt, artificial
  Oligomer
uugaaccugaccacuucaa

SEQ ID NO: 4856 - RNA, 19 nt, artificial
  Oligomer
cgguuuucccauuugaaag

SEQ ID NO: 4857 - RNA, 19 nt, artificial
  Oligomer
agaacaacaggagagucau

SEQ ID NO: 4858 - RNA, 19 nt, artificial
  Oligomer
ucacuuguugcaguacaau

SEQ ID NO: 4859 - RNA, 19 nt, artificial
  Oligomer
aacucaaugaaaucagcaa

SEQ ID NO: 4860 - RNA, 19 nt, artificial
  Oligomer
augcucacuuguugcagua

SEQ ID NO: 4861 - RNA, 19 nt, artificial
  Oligomer
aaagugggaaaccauucaa

SEQ ID NO: 4862 - RNA, 19 nt, artificial
  Oligomer
cauguucacugugagugaa

SEQ ID NO: 4863 - RNA, 19 nt, artificial
  Oligomer
aagugggaaaccauucaaa

SEQ ID NO: 4864 - RNA, 19 nt, artificial
  Oligomer
cacugugagugaaaauuuu

SEQ ID NO: 4865 - RNA, 19 nt, artificial
  Oligomer
ucacugugagugaaaauuu

SEQ ID NO: 4866 - RNA, 19 nt, artificial
  Oligomer
acucaaugaaaucagcaaa

SEQ ID NO: 4867 - RNA, 19 nt, artificial
  Oligomer
uucacugugagugaaaauu

SEQ ID NO: 4868 - RNA, 19 nt, artificial
  Oligomer
gcagacggcuucucacuua

SEQ ID NO: 4869 - RNA, 19 nt, artificial
  Oligomer
agcggaaaauggcagacaa

SEQ ID NO: 4870 - RNA, 19 nt, artificial
  Oligomer
aaaggcagguuauaaggca

SEQ ID NO: 4871 - RNA, 19 nt, artificial
  Oligomer
auuauccagcuuuguauug

SEQ ID NO: 4872 - RNA, 19 nt, artificial
  Oligomer
aaggcagguuauaaggcac

SEQ ID NO: 4873 - RNA, 19 nt, artificial
  Oligomer
uaugucaccagaaauuccc

SEQ ID NO: 4874 - RNA, 19 nt, artificial
  Oligomer
gagggauauugaugaaugu

SEQ ID NO: 4875 - RNA, 19 nt, artificial
  Oligomer
aaccaguacuuguauuuug

SEQ ID NO: 4876 - RNA, 19 nt, artificial
  Oligomer
guacuuguauuuugaaugg

SEQ ID NO: 4877 - RNA, 19 nt, artificial
  Oligomer
aaccgacugucuuucuucc

SEQ ID NO: 4878 - RNA, 19 nt, artificial
  Oligomer
aaauugucugccauuuucc

SEQ ID NO: 4879 - RNA, 19 nt, artificial
  Oligomer
cuuucagauuauaucaugg

SEQ ID NO: 4880 - RNA, 19 nt, artificial
  Oligomer
aacccgaugauuguacugc

SEQ ID NO: 4881 - RNA, 19 nt, artificial
  Oligomer
auugcaaacaaugacucuc

SEQ ID NO: 4882 - RNA, 19 nt, artificial
  Oligomer
aaaauugucugccauuuuc

SEQ ID NO: 4883 - RNA, 19 nt, artificial
  Oligomer
uuccagacccagauaacgc

SEQ ID NO: 4884 - RNA, 19 nt, artificial
  Oligomer
ucauugaguuuuuuaaccc

SEQ ID NO: 4885 - RNA, 19 nt, artificial
  Oligomer
cauugaguuuuuuaacccg

SEQ ID NO: 4886 - RNA, 19 nt, artificial
  Oligomer
accaguacuuguauuuuga

SEQ ID NO: 4887 - RNA, 19 nt, artificial
  Oligomer
aucauucacugcaaccuug

SEQ ID NO: 4888 - RNA, 19 nt, artificial
  Oligomer
uacacauguaagguuuaga

SEQ ID NO: 4889 - RNA, 19 nt, artificial
  Oligomer
augguauaugaagcacugg

SEQ ID NO: 4890 - RNA, 19 nt, artificial
  Oligomer
augaagcacuggugagguc

SEQ ID NO: 4891 - RNA, 19 nt, artificial
  Oligomer
auugaagcguggguuaaag

SEQ ID NO: 4892 - RNA, 19 nt, artificial
  Oligomer
aagcguggguuaaagugga

SEQ ID NO: 4893 - RNA, 19 nt, artificial
  Oligomer
guggguuaaaguggaaggc

SEQ ID NO: 4894 - RNA, 19 nt, artificial
  Oligomer
uuuccagacccagauaacg

SEQ ID NO: 4895 - RNA, 19 nt, artificial
  Oligomer
uaugaagcacuggugaggu

SEQ ID NO: 4896 - RNA, 19 nt, artificial
  Oligomer
aaaaccgacugucuuucuu

SEQ ID NO: 4897 - RNA, 19 nt, artificial
  Oligomer
accgacugucuuucuuccc

SEQ ID NO: 4898 - RNA, 19 nt, artificial
  Oligomer
gaagcguggguuaaagugg

SEQ ID NO: 4899 - RNA, 19 nt, artificial
  Oligomer
uuguuaucagcaugcgagg

SEQ ID NO: 4900 - RNA, 19 nt, artificial
  Oligomer
augaaaccuuuacacaugu

SEQ ID NO: 4901 - RNA, 19 nt, artificial
  Oligomer
uauaugaagcacuggugag

SEQ ID NO: 4902 - RNA, 19 nt, artificial
  Oligomer
cuaugucaccagaaauucc

SEQ ID NO: 4903 - RNA, 19 nt, artificial
  Oligomer
augucaccagaaauuccca

SEQ ID NO: 4904 - RNA, 19 nt, artificial
  Oligomer
uuuuuaacccgaugauugu

SEQ ID NO: 4905 - RNA, 19 nt, artificial
  Oligomer
caaaggcagguuauaaggc

SEQ ID NO: 4906 - RNA, 19 nt, artificial
  Oligomer
uccagacccagauaacgca

SEQ ID NO: 4907 - RNA, 19 nt, artificial
  Oligomer
uagaugacuuacaagaggg

SEQ ID NO: 4908 - RNA, 19 nt, artificial
  Oligomer
ugguauaugaagcacuggu

SEQ ID NO: 4909 - RNA, 19 nt, artificial
  Oligomer
ugucaccagaaauucccag

SEQ ID NO: 4910 - RNA, 19 nt, artificial
  Oligomer
uuuuuuaacccgaugauug

SEQ ID NO: 4911 - RNA, 19 nt, artificial
  Oligomer
gugcccagaauuguuauca

SEQ ID NO: 4912 - RNA, 19 nt, artificial
  Oligomer
aauuguuaucagcaugcga

SEQ ID NO: 4913 - RNA, 19 nt, artificial
  Oligomer
uguuaucagcaugcgaggc

SEQ ID NO: 4914 - RNA, 19 nt, artificial
  Oligomer
ucuaugucaccagaaauuc

SEQ ID NO: 4915 - RNA, 19 nt, artificial
  Oligomer
gaguuuuuuaacccgauga

SEQ ID NO: 4916 - RNA, 19 nt, artificial
  Oligomer
uuaacccgaugauuguacu

SEQ ID NO: 4917 - RNA, 19 nt, artificial
  Oligomer
ugcaaacaaugacucuccu

SEQ ID NO: 4918 - RNA, 19 nt, artificial
  Oligomer
caugguauaugaagcacug

SEQ ID NO: 4919 - RNA, 19 nt, artificial
  Oligomer
uaacccgaugauuguacug

SEQ ID NO: 4920 - RNA, 19 nt, artificial
  Oligomer
uucaccgugcccagaauug

SEQ ID NO: 4921 - RNA, 19 nt, artificial
  Oligomer
gugaacaugaaaccuuuac

SEQ ID NO: 4922 - RNA, 19 nt, artificial
  Oligomer
uuguauugcaaacaaugac

SEQ ID NO: 4923 - RNA, 19 nt, artificial
  Oligomer
ugcccagaauuguuaucag

SEQ ID NO: 4924 - RNA, 19 nt, artificial
  Oligomer
ucacagugaacaugaaacc

SEQ ID NO: 4925 - RNA, 19 nt, artificial
  Oligomer
acccgaugauuguacugca

SEQ ID NO: 4926 - RNA, 19 nt, artificial
  Oligomer
uauccagcuuuguauugca

SEQ ID NO: 4927 - RNA, 19 nt, artificial
  Oligomer
uuguucucauugaagcgug

SEQ ID NO: 4928 - RNA, 19 nt, artificial
  Oligomer
ugaacaugaaaccuuuaca

SEQ ID NO: 4929 - RNA, 19 nt, artificial
  Oligomer
aacaugaaaccuuuacaca

SEQ ID NO: 4930 - RNA, 19 nt, artificial
  Oligomer
cugucuuucuucccuuccc

SEQ ID NO: 4931 - RNA, 19 nt, artificial
  Oligomer
auccagcuuuguauugcaa

SEQ ID NO: 4932 - RNA, 19 nt, artificial
  Oligomer
ggaaaucuaaagcaauucu

SEQ ID NO: 4933 - RNA, 19 nt, artificial
  Oligomer
auaucaugguauaugaagc

SEQ ID NO: 4934 - RNA, 19 nt, artificial
  Oligomer
uaucaugguauaugaagca

SEQ ID NO: 4935 - RNA, 19 nt, artificial
  Oligomer
auucacugcaaccuugaag

SEQ ID NO: 4936 - RNA, 19 nt, artificial
  Oligomer
cuccuguuguucucauuga

SEQ ID NO: 4937 - RNA, 19 nt, artificial
  Oligomer
uguucucauugaagcgugg

SEQ ID NO: 4938 - RNA, 19 nt, artificial
  Oligomer
agaugacuuacaagaggga

SEQ ID NO: 4939 - RNA, 19 nt, artificial
  Oligomer
uucacugcaaccuugaagu

SEQ ID NO: 4940 - RNA, 19 nt, artificial
  Oligomer
aaaugggaaaaccgacugu

SEQ ID NO: 4941 - RNA, 19 nt, artificial
  Oligomer
uguuguucucauugaagcg

SEQ ID NO: 4942 - RNA, 19 nt, artificial
  Oligomer
guuguucucauugaagcgu

SEQ ID NO: 4943 - RNA, 19 nt, artificial
  Oligomer
uggaaggcaacaucauucc

SEQ ID NO: 4944 - RNA, 19 nt, artificial
  Oligomer
aaguagaugacuuacaaga

SEQ ID NO: 4945 - RNA, 19 nt, artificial
  Oligomer
uguauugcaaacaaugacu

SEQ ID NO: 4946 - RNA, 19 nt, artificial
  Oligomer
cuguuguucucauugaagc

SEQ ID NO: 4947 - RNA, 19 nt, artificial
  Oligomer
uucucauugaagcgugggu

SEQ ID NO: 4948 - RNA, 19 nt, artificial
  Oligomer
aaggcaacaucauucccuc

SEQ ID NO: 4949 - RNA, 19 nt, artificial
  Oligomer
cuguuugcauugggcuuca

SEQ ID NO: 4950 - RNA, 19 nt, artificial
  Oligomer
guuugcugauuucauugag

SEQ ID NO: 4951 - RNA, 19 nt, artificial
  Oligomer
uuucccacuuucaaauggg

SEQ ID NO: 4952 - RNA, 19 nt, artificial
  Oligomer
uugcauugggcuucaccgu

SEQ ID NO: 4953 - RNA, 19 nt, artificial
  Oligomer
auaaggcacaaucaguggc

SEQ ID NO: 4954 - RNA, 19 nt, artificial
  Oligomer
guagaugacuuacaagagg

SEQ ID NO: 4955 - RNA, 19 nt, artificial
  Oligomer
uuacacauguaagguuuag

SEQ ID NO: 4956 - RNA, 19 nt, artificial
  Oligomer
aucaugguauaugaagcac

SEQ ID NO: 4957 - RNA, 19 nt, artificial
  Oligomer
caaaugggaaaaccgacug

SEQ ID NO: 4958 - RNA, 19 nt, artificial
  Oligomer
cuugaggguuuggguuucc

SEQ ID NO: 4959 - RNA, 19 nt, artificial
  Oligomer
uuguacugcaacaagugag

SEQ ID NO: 4960 - RNA, 19 nt, artificial
  Oligomer
uauugcaaacaaugacucu

SEQ ID NO: 4961 - RNA, 19 nt, artificial
  Oligomer
uuaaaguggaaggcaacau

SEQ ID NO: 4962 - RNA, 19 nt, artificial
  Oligomer
auugaguuuuuuaacccga

SEQ ID NO: 4963 - RNA, 19 nt, artificial
  Oligomer
cacugcaaccuugaagugg

SEQ ID NO: 4964 - RNA, 19 nt, artificial
  Oligomer
guuucccacuuucaaaugg

SEQ ID NO: 4965 - RNA, 19 nt, artificial
  Oligomer
acuuucaaaugggaaaacc

SEQ ID NO: 4966 - RNA, 19 nt, artificial
  Oligomer
uucaaaugggaaaaccgac

SEQ ID NO: 4967 - RNA, 19 nt, artificial
  Oligomer
guauugcaaacaaugacuc

SEQ ID NO: 4968 - RNA, 19 nt, artificial
  Oligomer
guggaaggcaacaucauuc

SEQ ID NO: 4969 - RNA, 19 nt, artificial
  Oligomer
cucuuuggaaaucuaaagc

SEQ ID NO: 4970 - RNA, 19 nt, artificial
  Oligomer
ucuuuggaaaucuaaagca

SEQ ID NO: 4971 - RNA, 19 nt, artificial
  Oligomer
auuguuaucagcaugcgag

SEQ ID NO: 4972 - RNA, 19 nt, artificial
  Oligomer
uuggcuguccagaagaugg

SEQ ID NO: 4973 - RNA, 19 nt, artificial
  Oligomer
uugaggguuuggguuucca

SEQ ID NO: 4974 - RNA, 19 nt, artificial
  Oligomer
uucccaguuugcugauuuc

SEQ ID NO: 4975 - RNA, 19 nt, artificial
  Oligomer
uguacugcaacaagugagc

SEQ ID NO: 4976 - RNA, 19 nt, artificial
  Oligomer
aagugagcaucauucacug

SEQ ID NO: 4977 - RNA, 19 nt, artificial
  Oligomer
guucucauugaagcguggg

SEQ ID NO: 4978 - RNA, 19 nt, artificial
  Oligomer
auucccucuuuggaaaucu

SEQ ID NO: 4979 - RNA, 19 nt, artificial
  Oligomer
cuaaagcaauucuguuugc

SEQ ID NO: 4980 - RNA, 19 nt, artificial
  Oligomer
caauucuguuugcauuggg

SEQ ID NO: 4981 - RNA, 19 nt, artificial
  Oligomer
aaccuuuacacauguaagg

SEQ ID NO: 4982 - RNA, 19 nt, artificial
  Oligomer
ucaaaugggaaaaccgacu

SEQ ID NO: 4983 - RNA, 19 nt, artificial
  Oligomer
gaauuguuaucagcaugcg

SEQ ID NO: 4984 - RNA, 19 nt, artificial
  Oligomer
guuaucagcaugcgaggca

SEQ ID NO: 4985 - RNA, 19 nt, artificial
  Oligomer
cuguccagaagauggguag

SEQ ID NO: 4986 - RNA, 19 nt, artificial
  Oligomer
gugaggucuaugucaccag

SEQ ID NO: 4987 - RNA, 19 nt, artificial
  Oligomer
agugagcaucauucacugc

SEQ ID NO: 4988 - RNA, 19 nt, artificial
  Oligomer
acugcaaccuugaaguggu

SEQ ID NO: 4989 - RNA, 19 nt, artificial
  Oligomer
uaaagcaauucuguuugca

SEQ ID NO: 4990 - RNA, 19 nt, artificial
  Oligomer
auucccaguuugcugauuu

SEQ ID NO: 4991 - RNA, 19 nt, artificial
  Oligomer
gugagcaucauucacugca

SEQ ID NO: 4992 - RNA, 19 nt, artificial
  Oligomer
caaccuugaaguggucagg

SEQ ID NO: 4993 - RNA, 19 nt, artificial
  Oligomer
uucccacuuucaaauggga

SEQ ID NO: 4994 - RNA, 19 nt, artificial
  Oligomer
augggaaaaccgacugucu

SEQ ID NO: 4995 - RNA, 19 nt, artificial
  Oligomer
aacaaugacucuccuguug

SEQ ID NO: 4996 - RNA, 19 nt, artificial
  Oligomer
gaaggcaacaucauucccu

SEQ ID NO: 4997 - RNA, 19 nt, artificial
  Oligomer
gcaauucuguuugcauugg

SEQ ID NO: 4998 - RNA, 19 nt, artificial
  Oligomer
auucuguuugcauugggcu

SEQ ID NO: 4999 - RNA, 19 nt, artificial
  Oligomer
uuuucacucacagugaaca

SEQ ID NO: 5000 - RNA, 19 nt, artificial
  Oligomer
agacccagauaacgcauca

SEQ ID NO: 5001 - RNA, 19 nt, artificial
  Oligomer
cuuuacacauguaagguuu

SEQ ID NO: 5002 - RNA, 19 nt, artificial
  Oligomer
cuggugaggucuaugucac

SEQ ID NO: 5003 - RNA, 19 nt, artificial
  Oligomer
gaaauucccaguuugcuga

SEQ ID NO: 5004 - RNA, 19 nt, artificial
  Oligomer
gaaguggucagguucaacc

SEQ ID NO: 5005 - RNA, 19 nt, artificial
  Oligomer
aaguggucagguucaacca

SEQ ID NO: 5006 - RNA, 19 nt, artificial
  Oligomer
auuuugaaugguuucccac

SEQ ID NO: 5007 - RNA, 19 nt, artificial
  Oligomer
uuucaaaugggaaaaccga

SEQ ID NO: 5008 - RNA, 19 nt, artificial
  Oligomer
guuuggguuuccagaccca

SEQ ID NO: 5009 - RNA, 19 nt, artificial
  Oligomer
ugagacagguaauucacug

SEQ ID NO: 5010 - RNA, 19 nt, artificial
  Oligomer
gagacagguaauucacugu

SEQ ID NO: 5011 - RNA, 19 nt, artificial
  Oligomer
uugaguuuuuuaacccgau

SEQ ID NO: 5012 - RNA, 19 nt, artificial
  Oligomer
aagcacuggugaggucuau

SEQ ID NO: 5013 - RNA, 19 nt, artificial
  Oligomer
caagugagcaucauucacu

SEQ ID NO: 5014 - RNA, 19 nt, artificial
  Oligomer
aaccuugaaguggucaggu

SEQ ID NO: 5015 - RNA, 19 nt, artificial
  Oligomer
uugaaguggucagguucaa

SEQ ID NO: 5016 - RNA, 19 nt, artificial
  Oligomer
cuuucaaaugggaaaaccg

SEQ ID NO: 5017 - RNA, 19 nt, artificial
  Oligomer
augacucuccuguuguucu

SEQ ID NO: 5018 - RNA, 19 nt, artificial
  Oligomer
auuguacugcaacaaguga

SEQ ID NO: 5019 - RNA, 19 nt, artificial
  Oligomer
uugcugauuucauugaguu

SEQ ID NO: 5020 - RNA, 19 nt, artificial
  Oligomer
uacugcaacaagugagcau

SEQ ID NO: 5021 - RNA, 19 nt, artificial
  Oligomer
uugaaugguuucccacuuu

SEQ ID NO: 5022 - RNA, 19 nt, artificial
  Oligomer
uucacucacagugaacaug

SEQ ID NO: 5023 - RNA, 19 nt, artificial
  Oligomer
uuugaaugguuucccacuu

SEQ ID NO: 5024 - RNA, 19 nt, artificial
  Oligomer
aaaauuuucacucacagug

SEQ ID NO: 5025 - RNA, 19 nt, artificial
  Oligomer
aaauuuucacucacaguga

SEQ ID NO: 5026 - RNA, 19 nt, artificial
  Oligomer
uuugcugauuucauugagu

SEQ ID NO: 5027 - RNA, 19 nt, artificial
  Oligomer
aauuuucacucacagugaa

SEQ ID NO: 5028 - RNA, 19 nt, artificial
  Oligomer
uaagugagaagccgucugc

SEQ ID NO: 5029 - RNA, 19 nt, artificial
  Oligomer
uugucugccauuuuccgcu

SEQ ID NO: 5030 - RNA, 21 nt, artificial
  Oligomer
acauucaucaauaucccucuu

SEQ ID NO: 5031 - RNA, 21 nt, artificial
  Oligomer
gcaauacaaagcuggauaaua

SEQ ID NO: 5032 - RNA, 21 nt, artificial
  Oligomer
gggaaaccauucaaaauacaa

SEQ ID NO: 5033 - RNA, 21 nt, artificial
  Oligomer
ccauucaaaauacaaguacug

SEQ ID NO: 5034 - RNA, 21 nt, artificial
  Oligomer
ggaaaauggcagacaauuuuu

SEQ ID NO: 5035 - RNA, 21 nt, artificial
  Oligomer
gggaagaaagacagucgguuu

SEQ ID NO: 5036 - RNA, 21 nt, artificial
  Oligomer
ugugccuuauaaccugccuuu

SEQ ID NO: 5037 - RNA, 21 nt, artificial
  Oligomer
cggguuaaaaaacucaaugaa

SEQ ID NO: 5038 - RNA, 21 nt, artificial
  Oligomer
ccacuuuaacccacgcuucaa

SEQ ID NO: 5039 - RNA, 21 nt, artificial
  Oligomer
accucaccagugcuucauaua

SEQ ID NO: 5040 - RNA, 21 nt, artificial
  Oligomer
ggaagaaagacagucgguuuu

SEQ ID NO: 5041 - RNA, 21 nt, artificial
  Oligomer
caguacaaucaucggguuaaa

SEQ ID NO: 5042 - RNA, 21 nt, artificial
  Oligomer
aggagagucauuguuugcaau

SEQ ID NO: 5043 - RNA, 21 nt, artificial
  Oligomer
ucaaaauacaaguacugguug

SEQ ID NO: 5044 - RNA, 21 nt, artificial
  Oligomer
ggaaaccauucaaaauacaag

SEQ ID NO: 5045 - RNA, 21 nt, artificial
  Oligomer
caggagagucauuguuugcaa

SEQ ID NO: 5046 - RNA, 21 nt, artificial
  Oligomer
gcguuaucugggucuggaaac

SEQ ID NO: 5047 - RNA, 21 nt, artificial
  Oligomer
ccaugauauaaucugaaaggg

SEQ ID NO: 5048 - RNA, 21 nt, artificial
  Oligomer
ggaauuucuggugacauagac

SEQ ID NO: 5049 - RNA, 21 nt, artificial
  Oligomer
gcaguacaaucaucggguuaa

SEQ ID NO: 5050 - RNA, 21 nt, artificial
  Oligomer
cacuuuaacccacgcuucaau

SEQ ID NO: 5051 - RNA, 21 nt, artificial
  Oligomer
augcguuaucugggucuggaa

SEQ ID NO: 5052 - RNA, 21 nt, artificial
  Oligomer
gaaucuaaaccuuacaugugu

SEQ ID NO: 5053 - RNA, 21 nt, artificial
  Oligomer
caccagugcuucauauaccau

SEQ ID NO: 5054 - RNA, 21 nt, artificial
  Oligomer
gcaaacugggaauuucuggug

SEQ ID NO: 5055 - RNA, 21 nt, artificial
  Oligomer
caaaauacaaguacugguuga

SEQ ID NO: 5056 - RNA, 21 nt, artificial
  Oligomer
ugcguuaucugggucuggaaa

SEQ ID NO: 5057 - RNA, 21 nt, artificial
  Oligomer
ucaccagugcuucauauacca

SEQ ID NO: 5058 - RNA, 21 nt, artificial
  Oligomer
gaccucaccagugcuucauau

SEQ ID NO: 5059 - RNA, 21 nt, artificial
  Oligomer
gggaauuucuggugacauaga

SEQ ID NO: 5060 - RNA, 21 nt, artificial
  Oligomer
ugggaauuucuggugacauag

SEQ ID NO: 5061 - RNA, 21 nt, artificial
  Oligomer
cugggaauuucuggugacaua

SEQ ID NO: 5062 - RNA, 21 nt, artificial
  Oligomer
guacaaucaucggguuaaaaa

SEQ ID NO: 5063 - RNA, 21 nt, artificial
  Oligomer
aguacaaucaucggguuaaaa

SEQ ID NO: 5064 - RNA, 21 nt, artificial
  Oligomer
ugcaguacaaucaucggguua

SEQ ID NO: 5065 - RNA, 21 nt, artificial
  Oligomer
ucaagguugcagugaaugaug

SEQ ID NO: 5066 - RNA, 21 nt, artificial
  Oligomer
cuuccacuuuaacccacgcuu

SEQ ID NO: 5067 - RNA, 21 nt, artificial
  Oligomer
ccuuccacuuuaacccacgcu

SEQ ID NO: 5068 - RNA, 21 nt, artificial
  Oligomer
ccaaagagggaaugauguugc

SEQ ID NO: 5069 - RNA, 21 nt, artificial
  Oligomer
gcugauaacaauucugggcac

SEQ ID NO: 5070 - RNA, 21 nt, artificial
  Oligomer
acugggaauuucuggugacau

SEQ ID NO: 5071 - RNA, 21 nt, artificial
  Oligomer
caaacugggaauuucugguga

SEQ ID NO: 5072 - RNA, 21 nt, artificial
  Oligomer
cacgcuucaaugagaacaaca

SEQ ID NO: 5073 - RNA, 21 nt, artificial
  Oligomer
gugccuuauaaccugccuuug

SEQ ID NO: 5074 - RNA, 21 nt, artificial
  Oligomer
cagaauugcuuuagauuucca

SEQ ID NO: 5075 - RNA, 21 nt, artificial
  Oligomer
gcaugcugauaacaauucugg

SEQ ID NO: 5076 - RNA, 21 nt, artificial
  Oligomer
uucaucaauaucccucuugua

SEQ ID NO: 5077 - RNA, 21 nt, artificial
  Oligomer
acagucgguuuucccauuuga

SEQ ID NO: 5078 - RNA, 21 nt, artificial
  Oligomer
ugcugauaacaauucugggca

SEQ ID NO: 5079 - RNA, 21 nt, artificial
  Oligomer
ucaucaauaucccucuuguaa

SEQ ID NO: 5080 - RNA, 21 nt, artificial
  Oligomer
uugcaauacaaagcuggauaa

SEQ ID NO: 5081 - RNA, 21 nt, artificial
  Oligomer
acagaauugcuuuagauuucc

SEQ ID NO: 5082 - RNA, 21 nt, artificial
  Oligomer
uguguaaagguuucauguuca

SEQ ID NO: 5083 - RNA, 21 nt, artificial
  Oligomer
uugcaguacaaucaucggguu

SEQ ID NO: 5084 - RNA, 21 nt, artificial
  Oligomer
ugcaauacaaagcuggauaau

SEQ ID NO: 5085 - RNA, 21 nt, artificial
  Oligomer
ugaaaucagcaaacugggaau

SEQ ID NO: 5086 - RNA, 21 nt, artificial
  Oligomer
ggaagggaagaaagacagucg

SEQ ID NO: 5087 - RNA, 21 nt, artificial
  Oligomer
gagucauuguuugcaauacaa

SEQ ID NO: 5088 - RNA, 21 nt, artificial
  Oligomer
ucaauaucccucuuguaaguc

SEQ ID NO: 5089 - RNA, 21 nt, artificial
  Oligomer
gaaaucagcaaacugggaauu

SEQ ID NO: 5090 - RNA, 21 nt, artificial
  Oligomer
agagucauuguuugcaauaca

SEQ ID NO: 5091 - RNA, 21 nt, artificial
  Oligomer
caaugagaacaacaggagagu

SEQ ID NO: 5092 - RNA, 21 nt, artificial
  Oligomer
aucccucuuguaagucaucua

SEQ ID NO: 5093 - RNA, 21 nt, artificial
  Oligomer
ccacgcuucaaugagaacaac

SEQ ID NO: 5094 - RNA, 21 nt, artificial
  Oligomer
ccucuuguaagucaucuacuu

SEQ ID NO: 5095 - RNA, 21 nt, artificial
  Oligomer
gugcuucauauaccaugauau

SEQ ID NO: 5096 - RNA, 21 nt, artificial
  Oligomer
gcagugaaugaugcucacuug

SEQ ID NO: 5097 - RNA, 21 nt, artificial
  Oligomer
agacagucgguuuucccauuu

SEQ ID NO: 5098 - RNA, 21 nt, artificial
  Oligomer
ggagagucauuguuugcaaua

SEQ ID NO: 5099 - RNA, 21 nt, artificial
  Oligomer
uaacccacgcuucaaugagaa

SEQ ID NO: 5100 - RNA, 21 nt, artificial
  Oligomer
cccacgcuucaaugagaacaa

SEQ ID NO: 5101 - RNA, 21 nt, artificial
  Oligomer
ugaagcccaaugcaaacagaa

SEQ ID NO: 5102 - RNA, 21 nt, artificial
  Oligomer
cgcuucaaugagaacaacagg

SEQ ID NO: 5103 - RNA, 21 nt, artificial
  Oligomer
ccucgcaugcugauaacaauu

SEQ ID NO: 5104 - RNA, 21 nt, artificial
  Oligomer
ccacugauugugccuuauaac

SEQ ID NO: 5105 - RNA, 21 nt, artificial
  Oligomer
ggccacugauugugccuuaua

SEQ ID NO: 5106 - RNA, 21 nt, artificial
  Oligomer
cucuuguaagucaucuacuua

SEQ ID NO: 5107 - RNA, 21 nt, artificial
  Oligomer
cccucuuguaagucaucuacu

SEQ ID NO: 5108 - RNA, 21 nt, artificial
  Oligomer
cagucgguuuucccauuugaa

SEQ ID NO: 5109 - RNA, 21 nt, artificial
  Oligomer
gcaaacagaauugcuuuagau

SEQ ID NO: 5110 - RNA, 21 nt, artificial
  Oligomer
caaugcaaacagaauugcuuu

SEQ ID NO: 5111 - RNA, 21 nt, artificial
  Oligomer
ccaaugcaaacagaauugcuu

SEQ ID NO: 5112 - RNA, 21 nt, artificial
  Oligomer
agugcuucauauaccaugaua

SEQ ID NO: 5113 - RNA, 21 nt, artificial
  Oligomer
ugauguugccuuccacuuuaa

SEQ ID NO: 5114 - RNA, 21 nt, artificial
  Oligomer
ggaaugauguugccuuccacu

SEQ ID NO: 5115 - RNA, 21 nt, artificial
  Oligomer
cacggugaagcccaaugcaaa

SEQ ID NO: 5116 - RNA, 21 nt, artificial
  Oligomer
gggccacugauugugccuuau

SEQ ID NO: 5117 - RNA, 21 nt, artificial
  Oligomer
cuggaaacccaaacccucaag

SEQ ID NO: 5118 - RNA, 21 nt, artificial
  Oligomer
ugaccacuucaagguugcagu

SEQ ID NO: 5119 - RNA, 21 nt, artificial
  Oligomer
gaagcccaaugcaaacagaau

SEQ ID NO: 5120 - RNA, 21 nt, artificial
  Oligomer
ccuuauaaccugccuuugccu

SEQ ID NO: 5121 - RNA, 21 nt, artificial
  Oligomer
gccacugauugugccuuauaa

SEQ ID NO: 5122 - RNA, 21 nt, artificial
  Oligomer
ugggccacugauugugccuua

SEQ ID NO: 5123 - RNA, 21 nt, artificial
  Oligomer
ucccucuuguaagucaucuac

SEQ ID NO: 5124 - RNA, 21 nt, artificial
  Oligomer
agguuucauguucacugugag

SEQ ID NO: 5125 - RNA, 21 nt, artificial
  Oligomer
ugcucacuuguugcaguacaa

SEQ ID NO: 5126 - RNA, 21 nt, artificial
  Oligomer
gaaagugggaaaccauucaaa

SEQ ID NO: 5127 - RNA, 21 nt, artificial
  Oligomer
gacagucgguuuucccauuug

SEQ ID NO: 5128 - RNA, 21 nt, artificial
  Oligomer
agauuuccaaagagggaauga

SEQ ID NO: 5129 - RNA, 21 nt, artificial
  Oligomer
ccaucuucuggacagccaagu

SEQ ID NO: 5130 - RNA, 21 nt, artificial
  Oligomer
ggaaacccaaacccucaagga

SEQ ID NO: 5131 - RNA, 21 nt, artificial
  Oligomer
gguuucauguucacugugagu

SEQ ID NO: 5132 - RNA, 21 nt, artificial
  Oligomer
ccagugcuucauauaccauga

SEQ ID NO: 5133 - RNA, 21 nt, artificial
  Oligomer
agaccucaccagugcuucaua

SEQ ID NO: 5134 - RNA, 21 nt, artificial
  Oligomer
ccaugaugcguuaucuggguc

SEQ ID NO: 5135 - RNA, 21 nt, artificial
  Oligomer
gcucacuuguugcaguacaau

SEQ ID NO: 5136 - RNA, 21 nt, artificial
  Oligomer
gugccucgcaugcugauaaca

SEQ ID NO: 5137 - RNA, 21 nt, artificial
  Oligomer
acccaucuucuggacagccaa

SEQ ID NO: 5138 - RNA, 21 nt, artificial
  Oligomer
cagugcuucauauaccaugau

SEQ ID NO: 5139 - RNA, 21 nt, artificial
  Oligomer
gguugcagugaaugaugcuca

SEQ ID NO: 5140 - RNA, 21 nt, artificial
  Oligomer
ugggaaaccauucaaaauaca

SEQ ID NO: 5141 - RNA, 21 nt, artificial
  Oligomer
ugagaacaacaggagagucau

SEQ ID NO: 5142 - RNA, 21 nt, artificial
  Oligomer
gggaaugauguugccuuccac

SEQ ID NO: 5143 - RNA, 21 nt, artificial
  Oligomer
ugcuuuagauuuccaaagagg

SEQ ID NO: 5144 - RNA, 21 nt, artificial
  Oligomer
uugcuuuagauuuccaaagag

SEQ ID NO: 5145 - RNA, 21 nt, artificial
  Oligomer
cccaaugcaaacagaauugcu

SEQ ID NO: 5146 - RNA, 21 nt, artificial
  Oligomer
gccucgcaugcugauaacaau

SEQ ID NO: 5147 - RNA, 21 nt, artificial
  Oligomer
accuuacauguguaaagguuu

SEQ ID NO: 5148 - RNA, 21 nt, artificial
  Oligomer
caaguacugguugaaccugac

SEQ ID NO: 5149 - RNA, 21 nt, artificial
  Oligomer
gaagaaagacagucgguuuuc

SEQ ID NO: 5150 - RNA, 21 nt, artificial
  Oligomer
gaaugauguugccuuccacuu

SEQ ID NO: 5151 - RNA, 21 nt, artificial
  Oligomer
ggugaagcccaaugcaaacag

SEQ ID NO: 5152 - RNA, 21 nt, artificial
  Oligomer
cggugaagcccaaugcaaaca

SEQ ID NO: 5153 - RNA, 21 nt, artificial
  Oligomer
acagugaauuaccugucucaa

SEQ ID NO: 5154 - RNA, 21 nt, artificial
  Oligomer
auguucacugugagugaaaau

SEQ ID NO: 5155 - RNA, 21 nt, artificial
  Oligomer
ugaugcucacuuguugcagua

SEQ ID NO: 5156 - RNA, 21 nt, artificial
  Oligomer
gaccacuucaagguugcagug

SEQ ID NO: 5157 - RNA, 21 nt, artificial
  Oligomer
auacaaguacugguugaaccu

SEQ ID NO: 5158 - RNA, 21 nt, artificial
  Oligomer
gugggaaaccauucaaaauac

SEQ ID NO: 5159 - RNA, 21 nt, artificial
  Oligomer
acaacaggagagucauuguuu

SEQ ID NO: 5160 - RNA, 21 nt, artificial
  Oligomer
agagggaaugauguugccuuc

SEQ ID NO: 5161 - RNA, 21 nt, artificial
  Oligomer
gugaagcccaaugcaaacaga

SEQ ID NO: 5162 - RNA, 21 nt, artificial
  Oligomer
cgcaugcugauaacaauucug

SEQ ID NO: 5163 - RNA, 21 nt, artificial
  Oligomer
ggugacauagaccucaccagu

SEQ ID NO: 5164 - RNA, 21 nt, artificial
  Oligomer
aaaucagcaaacugggaauuu

SEQ ID NO: 5165 - RNA, 21 nt, artificial
  Oligomer
ucggguuaaaaaacucaauga

SEQ ID NO: 5166 - RNA, 21 nt, artificial
  Oligomer
ucaucggguuaaaaaacucaa

SEQ ID NO: 5167 - RNA, 21 nt, artificial
  Oligomer
ccugaccacuucaagguugca

SEQ ID NO: 5168 - RNA, 21 nt, artificial
  Oligomer
gaaccugaccacuucaagguu

SEQ ID NO: 5169 - RNA, 21 nt, artificial
  Oligomer
ugguugaaccugaccacuuca

SEQ ID NO: 5170 - RNA, 21 nt, artificial
  Oligomer
guacugguugaaccugaccac

SEQ ID NO: 5171 - RNA, 21 nt, artificial
  Oligomer
cauuugaaagugggaaaccau

SEQ ID NO: 5172 - RNA, 21 nt, artificial
  Oligomer
ccauuugaaagugggaaacca

SEQ ID NO: 5173 - RNA, 21 nt, artificial
  Oligomer
cgguuuucccauuugaaagug

SEQ ID NO: 5174 - RNA, 21 nt, artificial
  Oligomer
gaacaacaggagagucauugu

SEQ ID NO: 5175 - RNA, 21 nt, artificial
  Oligomer
agcccaaugcaaacagaauug

SEQ ID NO: 5176 - RNA, 21 nt, artificial
  Oligomer
ucgcaugcugauaacaauucu

SEQ ID NO: 5177 - RNA, 21 nt, artificial
  Oligomer
gaaacccaaacccucaaggau

SEQ ID NO: 5178 - RNA, 21 nt, artificial
  Oligomer
cuggugacauagaccucacca

SEQ ID NO: 5179 - RNA, 21 nt, artificial
  Oligomer
cacuuguugcaguacaaucau

SEQ ID NO: 5180 - RNA, 21 nt, artificial
  Oligomer
cagugaaugaugcucacuugu

SEQ ID NO: 5181 - RNA, 21 nt, artificial
  Oligomer
cccauuugaaagugggaaacc

SEQ ID NO: 5182 - RNA, 21 nt, artificial
  Oligomer
gagaacaacaggagagucauu

SEQ ID NO: 5183 - RNA, 21 nt, artificial
  Oligomer
uuagauuuccaaagagggaau

SEQ ID NO: 5184 - RNA, 21 nt, artificial
  Oligomer
ugcaaacagaauugcuuuaga

SEQ ID NO: 5185 - RNA, 21 nt, artificial
  Oligomer
gcccaaugcaaacagaauugc

SEQ ID NO: 5186 - RNA, 21 nt, artificial
  Oligomer
ugccucgcaugcugauaacaa

SEQ ID NO: 5187 - RNA, 21 nt, artificial
  Oligomer
ucauguucacugugagugaaa

SEQ ID NO: 5188 - RNA, 21 nt, artificial
  Oligomer
gacauagaccucaccagugcu

SEQ ID NO: 5189 - RNA, 21 nt, artificial
  Oligomer
caucggguuaaaaaacucaau

SEQ ID NO: 5190 - RNA, 21 nt, artificial
  Oligomer
ugcagugaaugaugcucacuu

SEQ ID NO: 5191 - RNA, 21 nt, artificial
  Oligomer
cacuucaagguugcagugaau

SEQ ID NO: 5192 - RNA, 21 nt, artificial
  Oligomer
ccacuucaagguugcagugaa

SEQ ID NO: 5193 - RNA, 21 nt, artificial
  Oligomer
gguugaaccugaccacuucaa

SEQ ID NO: 5194 - RNA, 21 nt, artificial
  Oligomer
ucccauuugaaagugggaaac

SEQ ID NO: 5195 - RNA, 21 nt, artificial
  Oligomer
uucccauuugaaagugggaaa

SEQ ID NO: 5196 - RNA, 21 nt, artificial
  Oligomer
gccuuauaaccugccuuugcc

SEQ ID NO: 5197 - RNA, 21 nt, artificial
  Oligomer
acauagaccucaccagugcuu

SEQ ID NO: 5198 - RNA, 21 nt, artificial
  Oligomer
guguaaagguuucauguucac

SEQ ID NO: 5199 - RNA, 21 nt, artificial
  Oligomer
acauguguaaagguuucaugu

SEQ ID NO: 5200 - RNA, 21 nt, artificial
  Oligomer
ucacuuguugcaguacaauca

SEQ ID NO: 5201 - RNA, 21 nt, artificial
  Oligomer
aaagugggaaaccauucaaaa

SEQ ID NO: 5202 - RNA, 21 nt, artificial
  Oligomer
ugaaagugggaaaccauucaa

SEQ ID NO: 5203 - RNA, 21 nt, artificial
  Oligomer
guucacugugagugaaaauuu

SEQ ID NO: 5204 - RNA, 21 nt, artificial
  Oligomer
cucaaugaaaucagcaaacug

SEQ ID NO: 5205 - RNA, 21 nt, artificial
  Oligomer
acucaaugaaaucagcaaacu

SEQ ID NO: 5206 - RNA, 21 nt, artificial
  Oligomer
aagagggauauugaugaaugu

SEQ ID NO: 5207 - RNA, 21 nt, artificial
  Oligomer
uauuauccagcuuuguauugc

SEQ ID NO: 5208 - RNA, 21 nt, artificial
  Oligomer
uuguauuuugaaugguuuccc

SEQ ID NO: 5209 - RNA, 21 nt, artificial
  Oligomer
caguacuuguauuuugaaugg

SEQ ID NO: 5210 - RNA, 21 nt, artificial
  Oligomer
aaaaauugucugccauuuucc

SEQ ID NO: 5211 - RNA, 21 nt, artificial
  Oligomer
aaaccgacugucuuucuuccc

SEQ ID NO: 5212 - RNA, 21 nt, artificial
  Oligomer
aaaggcagguuauaaggcaca

SEQ ID NO: 5213 - RNA, 21 nt, artificial
  Oligomer
uucauugaguuuuuuaacccg

SEQ ID NO: 5214 - RNA, 21 nt, artificial
  Oligomer
uugaagcguggguuaaagugg

SEQ ID NO: 5215 - RNA, 21 nt, artificial
  Oligomer
uauaugaagcacuggugaggu

SEQ ID NO: 5216 - RNA, 21 nt, artificial
  Oligomer
aaaaccgacugucuuucuucc

SEQ ID NO: 5217 - RNA, 21 nt, artificial
  Oligomer
uuuaacccgaugauuguacug

SEQ ID NO: 5218 - RNA, 21 nt, artificial
  Oligomer
auugcaaacaaugacucuccu

SEQ ID NO: 5219 - RNA, 21 nt, artificial
  Oligomer
caaccaguacuuguauuuuga

SEQ ID NO: 5220 - RNA, 21 nt, artificial
  Oligomer
cuuguauuuugaaugguuucc

SEQ ID NO: 5221 - RNA, 21 nt, artificial
  Oligomer
uugcaaacaaugacucuccug

SEQ ID NO: 5222 - RNA, 21 nt, artificial
  Oligomer
guuuccagacccagauaacgc

SEQ ID NO: 5223 - RNA, 21 nt, artificial
  Oligomer
cccuuucagauuauaucaugg

SEQ ID NO: 5224 - RNA, 21 nt, artificial
  Oligomer
gucuaugucaccagaaauucc

SEQ ID NO: 5225 - RNA, 21 nt, artificial
  Oligomer
uuaacccgaugauuguacugc

SEQ ID NO: 5226 - RNA, 21 nt, artificial
  Oligomer
auugaagcguggguuaaagug

SEQ ID NO: 5227 - RNA, 21 nt, artificial
  Oligomer
uuccagacccagauaacgcau

SEQ ID NO: 5228 - RNA, 21 nt, artificial
  Oligomer
acacauguaagguuuagauuc

SEQ ID NO: 5229 - RNA, 21 nt, artificial
  Oligomer
augguauaugaagcacuggug

SEQ ID NO: 5230 - RNA, 21 nt, artificial
  Oligomer
caccagaaauucccaguuugc

SEQ ID NO: 5231 - RNA, 21 nt, artificial
  Oligomer
ucaaccaguacuuguauuuug

SEQ ID NO: 5232 - RNA, 21 nt, artificial
  Oligomer
uuuccagacccagauaacgca

SEQ ID NO: 5233 - RNA, 21 nt, artificial
  Oligomer
ugguauaugaagcacugguga

SEQ ID NO: 5234 - RNA, 21 nt, artificial
  Oligomer
auaugaagcacuggugagguc

SEQ ID NO: 5235 - RNA, 21 nt, artificial
  Oligomer
ucuaugucaccagaaauuccc

SEQ ID NO: 5236 - RNA, 21 nt, artificial
  Oligomer
cuaugucaccagaaauuccca

SEQ ID NO: 5237 - RNA, 21 nt, artificial
  Oligomer
uaugucaccagaaauucccag

SEQ ID NO: 5238 - RNA, 21 nt, artificial
  Oligomer
uuuuuaacccgaugauuguac

SEQ ID NO: 5239 - RNA, 21 nt, artificial
  Oligomer
uuuuaacccgaugauuguacu

SEQ ID NO: 5240 - RNA, 21 nt, artificial
  Oligomer
uaacccgaugauuguacugca

SEQ ID NO: 5241 - RNA, 21 nt, artificial
  Oligomer
caucauucacugcaaccuuga

SEQ ID NO: 5242 - RNA, 21 nt, artificial
  Oligomer
aagcguggguuaaaguggaag

SEQ ID NO: 5243 - RNA, 21 nt, artificial
  Oligomer
agcguggguuaaaguggaagg

SEQ ID NO: 5244 - RNA, 21 nt, artificial
  Oligomer
gcaacaucauucccucuuugg

SEQ ID NO: 5245 - RNA, 21 nt, artificial
  Oligomer
gugcccagaauuguuaucagc

SEQ ID NO: 5246 - RNA, 21 nt, artificial
  Oligomer
augucaccagaaauucccagu

SEQ ID NO: 5247 - RNA, 21 nt, artificial
  Oligomer
ucaccagaaauucccaguuug

SEQ ID NO: 5248 - RNA, 21 nt, artificial
  Oligomer
uguuguucucauugaagcgug

SEQ ID NO: 5249 - RNA, 21 nt, artificial
  Oligomer
caaaggcagguuauaaggcac

SEQ ID NO: 5250 - RNA, 21 nt, artificial
  Oligomer
uggaaaucuaaagcaauucug

SEQ ID NO: 5251 - RNA, 21 nt, artificial
  Oligomer
ccagaauuguuaucagcaugc

SEQ ID NO: 5252 - RNA, 21 nt, artificial
  Oligomer
uacaagagggauauugaugaa

SEQ ID NO: 5253 - RNA, 21 nt, artificial
  Oligomer
ucaaaugggaaaaccgacugu

SEQ ID NO: 5254 - RNA, 21 nt, artificial
  Oligomer
ugcccagaauuguuaucagca

SEQ ID NO: 5255 - RNA, 21 nt, artificial
  Oligomer
uuacaagagggauauugauga

SEQ ID NO: 5256 - RNA, 21 nt, artificial
  Oligomer
uuauccagcuuuguauugcaa

SEQ ID NO: 5257 - RNA, 21 nt, artificial
  Oligomer
ggaaaucuaaagcaauucugu

SEQ ID NO: 5258 - RNA, 21 nt, artificial
  Oligomer
ugaacaugaaaccuuuacaca

SEQ ID NO: 5259 - RNA, 21 nt, artificial
  Oligomer
aacccgaugauuguacugcaa

SEQ ID NO: 5260 - RNA, 21 nt, artificial
  Oligomer
auuauccagcuuuguauugca

SEQ ID NO: 5261 - RNA, 21 nt, artificial
  Oligomer
auucccaguuugcugauuuca

SEQ ID NO: 5262 - RNA, 21 nt, artificial
  Oligomer
cgacugucuuucuucccuucc

SEQ ID NO: 5263 - RNA, 21 nt, artificial
  Oligomer
uuguauugcaaacaaugacuc

SEQ ID NO: 5264 - RNA, 21 nt, artificial
  Oligomer
gacuuacaagagggauauuga

SEQ ID NO: 5265 - RNA, 21 nt, artificial
  Oligomer
aauucccaguuugcugauuuc

SEQ ID NO: 5266 - RNA, 21 nt, artificial
  Oligomer
uguauugcaaacaaugacucu

SEQ ID NO: 5267 - RNA, 21 nt, artificial
  Oligomer
acucuccuguuguucucauug

SEQ ID NO: 5268 - RNA, 21 nt, artificial
  Oligomer
uagaugacuuacaagagggau

SEQ ID NO: 5269 - RNA, 21 nt, artificial
  Oligomer
guuguucucauugaagcgugg

SEQ ID NO: 5270 - RNA, 21 nt, artificial
  Oligomer
aaguagaugacuuacaagagg

SEQ ID NO: 5271 - RNA, 21 nt, artificial
  Oligomer
auaucaugguauaugaagcac

SEQ ID NO: 5272 - RNA, 21 nt, artificial
  Oligomer
caagugagcaucauucacugc

SEQ ID NO: 5273 - RNA, 21 nt, artificial
  Oligomer
aaaugggaaaaccgacugucu

SEQ ID NO: 5274 - RNA, 21 nt, artificial
  Oligomer
uauugcaaacaaugacucucc

SEQ ID NO: 5275 - RNA, 21 nt, artificial
  Oligomer
uucucauugaagcguggguua

SEQ ID NO: 5276 - RNA, 21 nt, artificial
  Oligomer
uuguucucauugaagcguggg

SEQ ID NO: 5277 - RNA, 21 nt, artificial
  Oligomer
uucuguuugcauugggcuuca

SEQ ID NO: 5278 - RNA, 21 nt, artificial
  Oligomer
ccuguuguucucauugaagcg

SEQ ID NO: 5279 - RNA, 21 nt, artificial
  Oligomer
aauuguuaucagcaugcgagg

SEQ ID NO: 5280 - RNA, 21 nt, artificial
  Oligomer
guuauaaggcacaaucagugg

SEQ ID NO: 5281 - RNA, 21 nt, artificial
  Oligomer
uauaaggcacaaucaguggcc

SEQ ID NO: 5282 - RNA, 21 nt, artificial
  Oligomer
uaaguagaugacuuacaagag

SEQ ID NO: 5283 - RNA, 21 nt, artificial
  Oligomer
aguagaugacuuacaagaggg

SEQ ID NO: 5284 - RNA, 21 nt, artificial
  Oligomer
uucaaaugggaaaaccgacug

SEQ ID NO: 5285 - RNA, 21 nt, artificial
  Oligomer
aucuaaagcaauucuguuugc

SEQ ID NO: 5286 - RNA, 21 nt, artificial
  Oligomer
aaagcaauucuguuugcauug

SEQ ID NO: 5287 - RNA, 21 nt, artificial
  Oligomer
aagcaauucuguuugcauugg

SEQ ID NO: 5288 - RNA, 21 nt, artificial
  Oligomer
uaucaugguauaugaagcacu

SEQ ID NO: 5289 - RNA, 21 nt, artificial
  Oligomer
uuaaaguggaaggcaacauca

SEQ ID NO: 5290 - RNA, 21 nt, artificial
  Oligomer
aguggaaggcaacaucauucc

SEQ ID NO: 5291 - RNA, 21 nt, artificial
  Oligomer
uuugcauugggcuucaccgug

SEQ ID NO: 5292 - RNA, 21 nt, artificial
  Oligomer
auaaggcacaaucaguggccc

SEQ ID NO: 5293 - RNA, 21 nt, artificial
  Oligomer
cuugaggguuuggguuuccag

SEQ ID NO: 5294 - RNA, 21 nt, artificial
  Oligomer
acugcaaccuugaagugguca

SEQ ID NO: 5295 - RNA, 21 nt, artificial
  Oligomer
auucuguuugcauugggcuuc

SEQ ID NO: 5296 - RNA, 21 nt, artificial
  Oligomer
aggcaaaggcagguuauaagg

SEQ ID NO: 5297 - RNA, 21 nt, artificial
  Oligomer
uuauaaggcacaaucaguggc

SEQ ID NO: 5298 - RNA, 21 nt, artificial
  Oligomer
uaaggcacaaucaguggccca

SEQ ID NO: 5299 - RNA, 21 nt, artificial
  Oligomer
guagaugacuuacaagaggga

SEQ ID NO: 5300 - RNA, 21 nt, artificial
  Oligomer
cucacagugaacaugaaaccu

SEQ ID NO: 5301 - RNA, 21 nt, artificial
  Oligomer
uuguacugcaacaagugagca

SEQ ID NO: 5302 - RNA, 21 nt, artificial
  Oligomer
uuugaaugguuucccacuuuc

SEQ ID NO: 5303 - RNA, 21 nt, artificial
  Oligomer
caaaugggaaaaccgacuguc

SEQ ID NO: 5304 - RNA, 21 nt, artificial
  Oligomer
ucauucccucuuuggaaaucu

SEQ ID NO: 5305 - RNA, 21 nt, artificial
  Oligomer
acuuggcuguccagaagaugg

SEQ ID NO: 5306 - RNA, 21 nt, artificial
  Oligomer
uccuugaggguuuggguuucc

SEQ ID NO: 5307 - RNA, 21 nt, artificial
  Oligomer
acucacagugaacaugaaacc

SEQ ID NO: 5308 - RNA, 21 nt, artificial
  Oligomer
ucaugguauaugaagcacugg

SEQ ID NO: 5309 - RNA, 21 nt, artificial
  Oligomer
uaugaagcacuggugaggucu

SEQ ID NO: 5310 - RNA, 21 nt, artificial
  Oligomer
gacccagauaacgcaucaugg

SEQ ID NO: 5311 - RNA, 21 nt, artificial
  Oligomer
auuguacugcaacaagugagc

SEQ ID NO: 5312 - RNA, 21 nt, artificial
  Oligomer
uguuaucagcaugcgaggcac

SEQ ID NO: 5313 - RNA, 21 nt, artificial
  Oligomer
uuggcuguccagaagaugggu

SEQ ID NO: 5314 - RNA, 21 nt, artificial
  Oligomer
aucaugguauaugaagcacug

SEQ ID NO: 5315 - RNA, 21 nt, artificial
  Oligomer
ugagcaucauucacugcaacc

SEQ ID NO: 5316 - RNA, 21 nt, artificial
  Oligomer
uguauuuugaaugguuuccca

SEQ ID NO: 5317 - RNA, 21 nt, artificial
  Oligomer
augacucuccuguuguucuca

SEQ ID NO: 5318 - RNA, 21 nt, artificial
  Oligomer
guggaaggcaacaucauuccc

SEQ ID NO: 5319 - RNA, 21 nt, artificial
  Oligomer
ccucuuuggaaaucuaaagca

SEQ ID NO: 5320 - RNA, 21 nt, artificial
  Oligomer
cucuuuggaaaucuaaagcaa

SEQ ID NO: 5321 - RNA, 21 nt, artificial
  Oligomer
agcaauucuguuugcauuggg

SEQ ID NO: 5322 - RNA, 21 nt, artificial
  Oligomer
auuguuaucagcaugcgaggc

SEQ ID NO: 5323 - RNA, 21 nt, artificial
  Oligomer
aaaccuuuacacauguaaggu

SEQ ID NO: 5324 - RNA, 21 nt, artificial
  Oligomer
gucagguucaaccaguacuug

SEQ ID NO: 5325 - RNA, 21 nt, artificial
  Oligomer
gaaaaccgacugucuuucuuc

SEQ ID NO: 5326 - RNA, 21 nt, artificial
  Oligomer
aaguggaaggcaacaucauuc

SEQ ID NO: 5327 - RNA, 21 nt, artificial
  Oligomer
cuguuugcauugggcuucacc

SEQ ID NO: 5328 - RNA, 21 nt, artificial
  Oligomer
uguuugcauugggcuucaccg

SEQ ID NO: 5329 - RNA, 21 nt, artificial
  Oligomer
uugagacagguaauucacugu

SEQ ID NO: 5330 - RNA, 21 nt, artificial
  Oligomer
auuuucacucacagugaacau

SEQ ID NO: 5331 - RNA, 21 nt, artificial
  Oligomer
uacugcaacaagugagcauca

SEQ ID NO: 5332 - RNA, 21 nt, artificial
  Oligomer
cacugcaaccuugaagugguc

SEQ ID NO: 5333 - RNA, 21 nt, artificial
  Oligomer
agguucaaccaguacuuguau

SEQ ID NO: 5334 - RNA, 21 nt, artificial
  Oligomer
guauuuugaaugguuucccac

SEQ ID NO: 5335 - RNA, 21 nt, artificial
  Oligomer
aaacaaugacucuccuguugu

SEQ ID NO: 5336 - RNA, 21 nt, artificial
  Oligomer
gaaggcaacaucauucccucu

SEQ ID NO: 5337 - RNA, 21 nt, artificial
  Oligomer
ucuguuugcauugggcuucac

SEQ ID NO: 5338 - RNA, 21 nt, artificial
  Oligomer
cagaauuguuaucagcaugcg

SEQ ID NO: 5339 - RNA, 21 nt, artificial
  Oligomer
acuggugaggucuaugucacc

SEQ ID NO: 5340 - RNA, 21 nt, artificial
  Oligomer
aaauucccaguuugcugauuu

SEQ ID NO: 5341 - RNA, 21 nt, artificial
  Oligomer
ucauugaguuuuuuaacccga

SEQ ID NO: 5342 - RNA, 21 nt, artificial
  Oligomer
uugaguuuuuuaacccgauga

SEQ ID NO: 5343 - RNA, 21 nt, artificial
  Oligomer
ugcaaccuugaaguggucagg

SEQ ID NO: 5344 - RNA, 21 nt, artificial
  Oligomer
aaccuugaaguggucagguuc

SEQ ID NO: 5345 - RNA, 21 nt, artificial
  Oligomer
ugaaguggucagguucaacca

SEQ ID NO: 5346 - RNA, 21 nt, artificial
  Oligomer
guggucagguucaaccaguac

SEQ ID NO: 5347 - RNA, 21 nt, artificial
  Oligomer
augguuucccacuuucaaaug

SEQ ID NO: 5348 - RNA, 21 nt, artificial
  Oligomer
ugguuucccacuuucaaaugg

SEQ ID NO: 5349 - RNA, 21 nt, artificial
  Oligomer
cacuuucaaaugggaaaaccg

SEQ ID NO: 5350 - RNA, 21 nt, artificial
  Oligomer
acaaugacucuccuguuguuc

SEQ ID NO: 5351 - RNA, 21 nt, artificial
  Oligomer
caauucuguuugcauugggcu

SEQ ID NO: 5352 - RNA, 21 nt, artificial
  Oligomer
agaauuguuaucagcaugcga

SEQ ID NO: 5353 - RNA, 21 nt, artificial
  Oligomer
auccuugaggguuuggguuuc

SEQ ID NO: 5354 - RNA, 21 nt, artificial
  Oligomer
uggugaggucuaugucaccag

SEQ ID NO: 5355 - RNA, 21 nt, artificial
  Oligomer
augauuguacugcaacaagug

SEQ ID NO: 5356 - RNA, 21 nt, artificial
  Oligomer
acaagugagcaucauucacug

SEQ ID NO: 5357 - RNA, 21 nt, artificial
  Oligomer
gguuucccacuuucaaauggg

SEQ ID NO: 5358 - RNA, 21 nt, artificial
  Oligomer
aaugacucuccuguuguucuc

SEQ ID NO: 5359 - RNA, 21 nt, artificial
  Oligomer
auucccucuuuggaaaucuaa

SEQ ID NO: 5360 - RNA, 21 nt, artificial
  Oligomer
ucuaaagcaauucuguuugca

SEQ ID NO: 5361 - RNA, 21 nt, artificial
  Oligomer
gcaauucuguuugcauugggc

SEQ ID NO: 5362 - RNA, 21 nt, artificial
  Oligomer
uuguuaucagcaugcgaggca

SEQ ID NO: 5363 - RNA, 21 nt, artificial
  Oligomer
uuucacucacagugaacauga

SEQ ID NO: 5364 - RNA, 21 nt, artificial
  Oligomer
agcacuggugaggucuauguc

SEQ ID NO: 5365 - RNA, 21 nt, artificial
  Oligomer
auugaguuuuuuaacccgaug

SEQ ID NO: 5366 - RNA, 21 nt, artificial
  Oligomer
aagugagcaucauucacugca

SEQ ID NO: 5367 - RNA, 21 nt, artificial
  Oligomer
auucacugcaaccuugaagug

SEQ ID NO: 5368 - RNA, 21 nt, artificial
  Oligomer
uucacugcaaccuugaagugg

SEQ ID NO: 5369 - RNA, 21 nt, artificial
  Oligomer
uugaaguggucagguucaacc

SEQ ID NO: 5370 - RNA, 21 nt, artificial
  Oligomer
guuucccacuuucaaauggga

SEQ ID NO: 5371 - RNA, 21 nt, artificial
  Oligomer
uuucccacuuucaaaugggaa

SEQ ID NO: 5372 - RNA, 21 nt, artificial
  Oligomer
ggcaaaggcagguuauaaggc

SEQ ID NO: 5373 - RNA, 21 nt, artificial
  Oligomer
aagcacuggugaggucuaugu

SEQ ID NO: 5374 - RNA, 21 nt, artificial
  Oligomer
gugaacaugaaaccuuuacac

SEQ ID NO: 5375 - RNA, 21 nt, artificial
  Oligomer
acaugaaaccuuuacacaugu

SEQ ID NO: 5376 - RNA, 21 nt, artificial
  Oligomer
ugauuguacugcaacaaguga

SEQ ID NO: 5377 - RNA, 21 nt, artificial
  Oligomer
uuuugaaugguuucccacuuu

SEQ ID NO: 5378 - RNA, 21 nt, artificial
  Oligomer
uugaaugguuucccacuuuca

SEQ ID NO: 5379 - RNA, 21 nt, artificial
  Oligomer
aaauuuucacucacagugaac

SEQ ID NO: 5380 - RNA, 21 nt, artificial
  Oligomer
caguuugcugauuucauugag

SEQ ID NO: 5381 - RNA, 21 nt, artificial
  Oligomer
aguuugcugauuucauugagu

SEQ ID NO: 5382 - RNA, 19 nt, artificial
  Oligomer
cggaauuaaugugccacaa

SEQ ID NO: 5383 - RNA, 19 nt, artificial
  Oligomer
gacuuccuuugcccuuuuu

SEQ ID NO: 5384 - RNA, 19 nt, artificial
  Oligomer
ccagugugccacauuaaau

SEQ ID NO: 5385 - RNA, 19 nt, artificial
  Oligomer
agauuucauuaccuccuac

SEQ ID NO: 5386 - RNA, 19 nt, artificial
  Oligomer
gccacuacauugccaucau

SEQ ID NO: 5387 - RNA, 19 nt, artificial
  Oligomer
cagugugccacauuaaaua

SEQ ID NO: 5388 - RNA, 19 nt, artificial
  Oligomer
ucaguuuuuugacuuccuu

SEQ ID NO: 5389 - RNA, 19 nt, artificial
  Oligomer
gucauuuccagauuucauu

SEQ ID NO: 5390 - RNA, 19 nt, artificial
  Oligomer
acauuaaauacccgugcag

SEQ ID NO: 5391 - RNA, 19 nt, artificial
  Oligomer
gccagugugccacauuaaa

SEQ ID NO: 5392 - RNA, 19 nt, artificial
  Oligomer
ccaacagcaagcggauuuu

SEQ ID NO: 5393 - RNA, 19 nt, artificial
  Oligomer
cuacuugccauucacccau

SEQ ID NO: 5394 - RNA, 19 nt, artificial
  Oligomer
gggccaucuggaacuauau

SEQ ID NO: 5395 - RNA, 19 nt, artificial
  Oligomer
gcagaugucucccaaaaag

SEQ ID NO: 5396 - RNA, 19 nt, artificial
  Oligomer
uugccauucacccaucaau

SEQ ID NO: 5397 - RNA, 19 nt, artificial
  Oligomer
ccuccuacuugccauucac

SEQ ID NO: 5398 - RNA, 19 nt, artificial
  Oligomer
accuccuacuugccauuca

SEQ ID NO: 5399 - RNA, 19 nt, artificial
  Oligomer
gaauuaaugugccacaagu

SEQ ID NO: 5400 - RNA, 19 nt, artificial
  Oligomer
ggaauuaaugugccacaag

SEQ ID NO: 5401 - RNA, 19 nt, artificial
  Oligomer
ugcuaccaguuccauauga

SEQ ID NO: 5402 - RNA, 19 nt, artificial
  Oligomer
ccaguguucaagugcagaa

SEQ ID NO: 5403 - RNA, 19 nt, artificial
  Oligomer
gcaugugaugacuguaaau

SEQ ID NO: 5404 - RNA, 19 nt, artificial
  Oligomer
cggauuuucuugcaagauc

SEQ ID NO: 5405 - RNA, 19 nt, artificial
  Oligomer
ccucuuuauuuugguccuu

SEQ ID NO: 5406 - RNA, 19 nt, artificial
  Oligomer
gaauccuaguucaguuuuu

SEQ ID NO: 5407 - RNA, 19 nt, artificial
  Oligomer
ccaucaaugugaaagucag

SEQ ID NO: 5408 - RNA, 19 nt, artificial
  Oligomer
ggccaagcucggaauuaau

SEQ ID NO: 5409 - RNA, 19 nt, artificial
  Oligomer
caguuccauaugaugagaa

SEQ ID NO: 5410 - RNA, 19 nt, artificial
  Oligomer
ucaucaccaaggaacacau

SEQ ID NO: 5411 - RNA, 19 nt, artificial
  Oligomer
ugacugugaauuacgacuu

SEQ ID NO: 5412 - RNA, 19 nt, artificial
  Oligomer
ggauuuucuugcaagauca

SEQ ID NO: 5413 - RNA, 19 nt, artificial
  Oligomer
gcggauuuucuugcaagau

SEQ ID NO: 5414 - RNA, 19 nt, artificial
  Oligomer
cgcagaugucucccaaaaa

SEQ ID NO: 5415 - RNA, 19 nt, artificial
  Oligomer
cucuuuauuuugguccuuu

SEQ ID NO: 5416 - RNA, 19 nt, artificial
  Oligomer
agaggagggaguauuagau

SEQ ID NO: 5417 - RNA, 19 nt, artificial
  Oligomer
ccuuugcccuuuuucccuu

SEQ ID NO: 5418 - RNA, 19 nt, artificial
  Oligomer
cgaauccuaguucaguuuu

SEQ ID NO: 5419 - RNA, 19 nt, artificial
  Oligomer
cuggaauggacaguucauu

SEQ ID NO: 5420 - RNA, 19 nt, artificial
  Oligomer
aguuccauaugaugagaaa

SEQ ID NO: 5421 - RNA, 19 nt, artificial
  Oligomer
ccaggguucuuguuuggac

SEQ ID NO: 5422 - RNA, 19 nt, artificial
  Oligomer
uuaccuccuacuugccauu

SEQ ID NO: 5423 - RNA, 19 nt, artificial
  Oligomer
ucggaauuaaugugccaca

SEQ ID NO: 5424 - RNA, 19 nt, artificial
  Oligomer
ggccaucuggaacuauauc

SEQ ID NO: 5425 - RNA, 19 nt, artificial
  Oligomer
gccucaccuacaauaccau

SEQ ID NO: 5426 - RNA, 19 nt, artificial
  Oligomer
agaaaucuuuggcuuugcu

SEQ ID NO: 5427 - RNA, 19 nt, artificial
  Oligomer
cuguagcaaaugacuguga

SEQ ID NO: 5428 - RNA, 19 nt, artificial
  Oligomer
gcucggaauuaaugugcca

SEQ ID NO: 5429 - RNA, 19 nt, artificial
  Oligomer
ccaagcucggaauuaaugu

SEQ ID NO: 5430 - RNA, 19 nt, artificial
  Oligomer
gaagaguccagcaccaaag

SEQ ID NO: 5431 - RNA, 19 nt, artificial
  Oligomer
ggauuauaccugggaagac

SEQ ID NO: 5432 - RNA, 19 nt, artificial
  Oligomer
cucuccuccuucguguuug

SEQ ID NO: 5433 - RNA, 19 nt, artificial
  Oligomer
gcuuugcuaccaguuccau

SEQ ID NO: 5434 - RNA, 19 nt, artificial
  Oligomer
gacuucucuugcccuucuu

SEQ ID NO: 5435 - RNA, 19 nt, artificial
  Oligomer
guagcaaaugacugugaau

SEQ ID NO: 5436 - RNA, 19 nt, artificial
  Oligomer
ccaucccaguaucucaucu

SEQ ID NO: 5437 - RNA, 19 nt, artificial
  Oligomer
agcggauuuucuugcaaga

SEQ ID NO: 5438 - RNA, 19 nt, artificial
  Oligomer
ggcaccaggguucuuguuu

SEQ ID NO: 5439 - RNA, 19 nt, artificial
  Oligomer
cugaagaggagggaguauu

SEQ ID NO: 5440 - RNA, 19 nt, artificial
  Oligomer
cuuuuucccuuuucuccau

SEQ ID NO: 5441 - RNA, 19 nt, artificial
  Oligomer
cuuugcccuuuuucccuuu

SEQ ID NO: 5442 - RNA, 19 nt, artificial
  Oligomer
caguuuuuugacuuccuuu

SEQ ID NO: 5443 - RNA, 19 nt, artificial
  Oligomer
caagcucggaauuaaugug

SEQ ID NO: 5444 - RNA, 19 nt, artificial
  Oligomer
acuauauccacugcgucuu

SEQ ID NO: 5445 - RNA, 19 nt, artificial
  Oligomer
ugcacccugacuacuuuac

SEQ ID NO: 5446 - RNA, 19 nt, artificial
  Oligomer
cagacaugcugugcuuugu

SEQ ID NO: 5447 - RNA, 19 nt, artificial
  Oligomer
cugcacccugacuacuuua

SEQ ID NO: 5448 - RNA, 19 nt, artificial
  Oligomer
accaguuccauaugaugag

SEQ ID NO: 5449 - RNA, 19 nt, artificial
  Oligomer
cuagagggcaugugaugac

SEQ ID NO: 5450 - RNA, 19 nt, artificial
  Oligomer
cccuucuucuagcagucug

SEQ ID NO: 5451 - RNA, 19 nt, artificial
  Oligomer
uccucuuuauuuugguccu

SEQ ID NO: 5452 - RNA, 19 nt, artificial
  Oligomer
ggaauggacaguucauugc

SEQ ID NO: 5453 - RNA, 19 nt, artificial
  Oligomer
cacccugacuacuuuacca

SEQ ID NO: 5454 - RNA, 19 nt, artificial
  Oligomer
ugcugugcuuuguggaaga

SEQ ID NO: 5455 - RNA, 19 nt, artificial
  Oligomer
ugaugagaaauaaacguuc

SEQ ID NO: 5456 - RNA, 19 nt, artificial
  Oligomer
ugaugacuguaaauguuca

SEQ ID NO: 5457 - RNA, 19 nt, artificial
  Oligomer
ccgauuccaggcacuuucu

SEQ ID NO: 5458 - RNA, 19 nt, artificial
  Oligomer
acagcaagcggauuuucuu

SEQ ID NO: 5459 - RNA, 19 nt, artificial
  Oligomer
cccacaaugucugaagcug

SEQ ID NO: 5460 - RNA, 19 nt, artificial
  Oligomer
cuagauggcuuagguggca

SEQ ID NO: 5461 - RNA, 19 nt, artificial
  Oligomer
uugcccuuuuucccuuuuc

SEQ ID NO: 5462 - RNA, 19 nt, artificial
  Oligomer
uccuaguucaguuuuuuga

SEQ ID NO: 5463 - RNA, 19 nt, artificial
  Oligomer
cgaguuucugcagacuggu

SEQ ID NO: 5464 - RNA, 19 nt, artificial
  Oligomer
ccagauuucauuaccuccu

SEQ ID NO: 5465 - RNA, 19 nt, artificial
  Oligomer
cgccaucaguguucuuacc

SEQ ID NO: 5466 - RNA, 19 nt, artificial
  Oligomer
ugagaaauaaacguucgcu

SEQ ID NO: 5467 - RNA, 19 nt, artificial
  Oligomer
uucaagugcagaaaucuuu

SEQ ID NO: 5468 - RNA, 19 nt, artificial
  Oligomer
gugguauccaguguucaag

SEQ ID NO: 5469 - RNA, 19 nt, artificial
  Oligomer
ucuggguucuagagggcau

SEQ ID NO: 5470 - RNA, 19 nt, artificial
  Oligomer
gaguagacaaccuggcagu

SEQ ID NO: 5471 - RNA, 19 nt, artificial
  Oligomer
cucagcgagaucaacaagu

SEQ ID NO: 5472 - RNA, 19 nt, artificial
  Oligomer
cacauugccuucugaagag

SEQ ID NO: 5473 - RNA, 19 nt, artificial
  Oligomer
ccuuuucuccaugcuuaau

SEQ ID NO: 5474 - RNA, 19 nt, artificial
  Oligomer
gcuugugugugaugugcag

SEQ ID NO: 5475 - RNA, 19 nt, artificial
  Oligomer
ggcuugugugugaugugca

SEQ ID NO: 5476 - RNA, 19 nt, artificial
  Oligomer
ccgccaucaguguucuuac

SEQ ID NO: 5477 - RNA, 19 nt, artificial
  Oligomer
cagugggcuugugugugau

SEQ ID NO: 5478 - RNA, 19 nt, artificial
  Oligomer
cuuucggauaugaggacuu

SEQ ID NO: 5479 - RNA, 19 nt, artificial
  Oligomer
gagaaauaaacguucgcug

SEQ ID NO: 5480 - RNA, 19 nt, artificial
  Oligomer
cagaaaucuuuggcuuugc

SEQ ID NO: 5481 - RNA, 19 nt, artificial
  Oligomer
ccuucuucuagcagucugu

SEQ ID NO: 5482 - RNA, 19 nt, artificial
  Oligomer
ccuuuaugcuugagguucc

SEQ ID NO: 5483 - RNA, 19 nt, artificial
  Oligomer
ggucacauugccuucugaa

SEQ ID NO: 5484 - RNA, 19 nt, artificial
  Oligomer
ucuagagaguuugagccuu

SEQ ID NO: 5485 - RNA, 19 nt, artificial
  Oligomer
gcaaacucagcgagaucaa

SEQ ID NO: 5486 - RNA, 19 nt, artificial
  Oligomer
ucaaugugaaagucagggu

SEQ ID NO: 5487 - RNA, 19 nt, artificial
  Oligomer
gccaucaguguucuuaccu

SEQ ID NO: 5488 - RNA, 19 nt, artificial
  Oligomer
agcugcuggaugagaaguu

SEQ ID NO: 5489 - RNA, 19 nt, artificial
  Oligomer
cguucgcugagguuuuguu

SEQ ID NO: 5490 - RNA, 19 nt, artificial
  Oligomer
cccaucccaguaucucauc

SEQ ID NO: 5491 - RNA, 19 nt, artificial
  Oligomer
aggcaccaggguucuuguu

SEQ ID NO: 5492 - RNA, 19 nt, artificial
  Oligomer
agagggcacaggaaagaag

SEQ ID NO: 5493 - RNA, 19 nt, artificial
  Oligomer
gugggcuugugugugaugu

SEQ ID NO: 5494 - RNA, 19 nt, artificial
  Oligomer
agccucaccuacaauacca

SEQ ID NO: 5495 - RNA, 19 nt, artificial
  Oligomer
agagggagaauucuguucu

SEQ ID NO: 5496 - RNA, 19 nt, artificial
  Oligomer
caaugugaaagucaggguc

SEQ ID NO: 5497 - RNA, 19 nt, artificial
  Oligomer
ggcuuaaguggguugcuuc

SEQ ID NO: 5498 - RNA, 19 nt, artificial
  Oligomer
ggaggagagggagaauucu

SEQ ID NO: 5499 - RNA, 19 nt, artificial
  Oligomer
gcugcuggaugagaaguuc

SEQ ID NO: 5500 - RNA, 19 nt, artificial
  Oligomer
cgcugagguuuuguuucau

SEQ ID NO: 5501 - RNA, 19 nt, artificial
  Oligomer
gggcacugaagaaaggcaa

SEQ ID NO: 5502 - RNA, 19 nt, artificial
  Oligomer
cccaaaaaguugagccuuu

SEQ ID NO: 5503 - RNA, 19 nt, artificial
  Oligomer
gcuuaauggugugaggcgu

SEQ ID NO: 5504 - RNA, 19 nt, artificial
  Oligomer
cccuuuucuccaugcuuaa

SEQ ID NO: 5505 - RNA, 19 nt, artificial
  Oligomer
ucccuuuucuccaugcuua

SEQ ID NO: 5506 - RNA, 19 nt, artificial
  Oligomer
ugcccuuuuucccuuuucu

SEQ ID NO: 5507 - RNA, 19 nt, artificial
  Oligomer
ugacuuccuuugcccuuuu

SEQ ID NO: 5508 - RNA, 19 nt, artificial
  Oligomer
acccucccuuuuccucacu

SEQ ID NO: 5509 - RNA, 19 nt, artificial
  Oligomer
ggaaccucaaggucuauau

SEQ ID NO: 5510 - RNA, 19 nt, artificial
  Oligomer
gcacugaagaaaggcaagg

SEQ ID NO: 5511 - RNA, 19 nt, artificial
  Oligomer
gcccuuuuucccuuuucuc

SEQ ID NO: 5512 - RNA, 19 nt, artificial
  Oligomer
cccugucauuuccagauuu

SEQ ID NO: 5513 - RNA, 19 nt, artificial
  Oligomer
gacaguucauugcacugac

SEQ ID NO: 5514 - RNA, 19 nt, artificial
  Oligomer
caguguucaagugcagaaa

SEQ ID NO: 5515 - RNA, 19 nt, artificial
  Oligomer
ugcgcaaacucagcgagau

SEQ ID NO: 5516 - RNA, 19 nt, artificial
  Oligomer
agaagguccacgugaacuu

SEQ ID NO: 5517 - RNA, 19 nt, artificial
  Oligomer
guguucaagugcagaaauc

SEQ ID NO: 5518 - RNA, 19 nt, artificial
  Oligomer
gggagugguauccaguguu

SEQ ID NO: 5519 - RNA, 19 nt, artificial
  Oligomer
ccaaaaaguugagccuuuc

SEQ ID NO: 5520 - RNA, 19 nt, artificial
  Oligomer
acccaucaaugugaaaguc

SEQ ID NO: 5521 - RNA, 19 nt, artificial
  Oligomer
acaguucauugcacugacu

SEQ ID NO: 5522 - RNA, 19 nt, artificial
  Oligomer
ggacaguucauugcacuga

SEQ ID NO: 5523 - RNA, 19 nt, artificial
  Oligomer
cccuuuuccucacuggaau

SEQ ID NO: 5524 - RNA, 19 nt, artificial
  Oligomer
cccgaagaauguacaaccu

SEQ ID NO: 5525 - RNA, 19 nt, artificial
  Oligomer
aggucuauaucaagacagu

SEQ ID NO: 5526 - RNA, 19 nt, artificial
  Oligomer
cugacuacuuuaccagcuu

SEQ ID NO: 5527 - RNA, 19 nt, artificial
  Oligomer
ccaggauuauaccugggaa

SEQ ID NO: 5528 - RNA, 19 nt, artificial
  Oligomer
cccagacaugcugugcuuu

SEQ ID NO: 5529 - RNA, 19 nt, artificial
  Oligomer
ggccagugugccacauuaa

SEQ ID NO: 5530 - RNA, 19 nt, artificial
  Oligomer
caggcacuuucuguagcaa

SEQ ID NO: 5531 - RNA, 19 nt, artificial
  Oligomer
aggugaccauggcuacauu

SEQ ID NO: 5532 - RNA, 19 nt, artificial
  Oligomer
uugacuuccuuugcccuuu

SEQ ID NO: 5533 - RNA, 19 nt, artificial
  Oligomer
ugacacuccaggcagcuuu

SEQ ID NO: 5534 - RNA, 19 nt, artificial
  Oligomer
cgaagaauguacaaccucu

SEQ ID NO: 5535 - RNA, 19 nt, artificial
  Oligomer
cggaaccucaaggucuaua

SEQ ID NO: 5536 - RNA, 19 nt, artificial
  Oligomer
gcgucuuuggcaucagaua

SEQ ID NO: 5537 - RNA, 19 nt, artificial
  Oligomer
ccuacaauaccaucgccau

SEQ ID NO: 5538 - RNA, 19 nt, artificial
  Oligomer
gugcagaaaucuuuggcuu

SEQ ID NO: 5539 - RNA, 19 nt, artificial
  Oligomer
agggagugguauccagugu

SEQ ID NO: 5540 - RNA, 19 nt, artificial
  Oligomer
cacauuaaauacccgugca

SEQ ID NO: 5541 - RNA, 19 nt, artificial
  Oligomer
ccacauuaaauacccgugc

SEQ ID NO: 5542 - RNA, 19 nt, artificial
  Oligomer
aggcacuuucuguagcaaa

SEQ ID NO: 5543 - RNA, 19 nt, artificial
  Oligomer
ccgaauccuaguucaguuu

SEQ ID NO: 5544 - RNA, 19 nt, artificial
  Oligomer
cccgaauccuaguucaguu

SEQ ID NO: 5545 - RNA, 19 nt, artificial
  Oligomer
ccuaaaagccuguucuguu

SEQ ID NO: 5546 - RNA, 19 nt, artificial
  Oligomer
cccuaaaagccuguucugu

SEQ ID NO: 5547 - RNA, 19 nt, artificial
  Oligomer
acgugaacuugcugcuccu

SEQ ID NO: 5548 - RNA, 19 nt, artificial
  Oligomer
gaagaauguacaaccucuu

SEQ ID NO: 5549 - RNA, 19 nt, artificial
  Oligomer
ggaacuauauccacugcgu

SEQ ID NO: 5550 - RNA, 19 nt, artificial
  Oligomer
ccaucuggaacuauaucca

SEQ ID NO: 5551 - RNA, 19 nt, artificial
  Oligomer
accuacaauaccaucgcca

SEQ ID NO: 5552 - RNA, 19 nt, artificial
  Oligomer
uuguggaagacccuacuuu

SEQ ID NO: 5553 - RNA, 19 nt, artificial
  Oligomer
ucgcugagguuuuguuuca

SEQ ID NO: 5554 - RNA, 19 nt, artificial
  Oligomer
ggcuuugcuaccaguucca

SEQ ID NO: 5555 - RNA, 19 nt, artificial
  Oligomer
aguguucaagugcagaaau

SEQ ID NO: 5556 - RNA, 19 nt, artificial
  Oligomer
gccacauuaaauacccgug

SEQ ID NO: 5557 - RNA, 19 nt, artificial
  Oligomer
uggccagugugccacauua

SEQ ID NO: 5558 - RNA, 19 nt, artificial
  Oligomer
gcacuuucuguagcaaaug

SEQ ID NO: 5559 - RNA, 19 nt, artificial
  Oligomer
caggugaccauggcuacau

SEQ ID NO: 5560 - RNA, 19 nt, artificial
  Oligomer
gcgagaucaacaaguugcu

SEQ ID NO: 5561 - RNA, 19 nt, artificial
  Oligomer
gccuuugcuggucacauug

SEQ ID NO: 5562 - RNA, 19 nt, artificial
  Oligomer
cacccaucaaugugaaagu

SEQ ID NO: 5563 - RNA, 19 nt, artificial
  Oligomer
gccauucacccaucaaugu

SEQ ID NO: 5564 - RNA, 19 nt, artificial
  Oligomer
ccugucauuuccagauuuc

SEQ ID NO: 5565 - RNA, 19 nt, artificial
  Oligomer
ccacaaguguuguggccuu

SEQ ID NO: 5566 - RNA, 19 nt, artificial
  Oligomer
ccacccgaagaauguacaa

SEQ ID NO: 5567 - RNA, 19 nt, artificial
  Oligomer
gcaucagauaugaugacua

SEQ ID NO: 5568 - RNA, 19 nt, artificial
  Oligomer
ggaagacccuacuuucgga

SEQ ID NO: 5569 - RNA, 19 nt, artificial
  Oligomer
ggaagaguccagcaccaaa

SEQ ID NO: 5570 - RNA, 19 nt, artificial
  Oligomer
ugacuguaaauguucacug

SEQ ID NO: 5571 - RNA, 19 nt, artificial
  Oligomer
caagcggauuuucuugcaa

SEQ ID NO: 5572 - RNA, 19 nt, artificial
  Oligomer
gcaagcggauuuucuugca

SEQ ID NO: 5573 - RNA, 19 nt, artificial
  Oligomer
uggcuacauugccaaaccu

SEQ ID NO: 5574 - RNA, 19 nt, artificial
  Oligomer
agccuuucuagauggcuua

SEQ ID NO: 5575 - RNA, 19 nt, artificial
  Oligomer
cucccaaaaaguugagccu

SEQ ID NO: 5576 - RNA, 19 nt, artificial
  Oligomer
agaugucucccaaaaaguu

SEQ ID NO: 5577 - RNA, 19 nt, artificial
  Oligomer
guccuuuaugcuugagguu

SEQ ID NO: 5578 - RNA, 19 nt, artificial
  Oligomer
gauuaucucuagagaguuu

SEQ ID NO: 5579 - RNA, 19 nt, artificial
  Oligomer
ccauucacccaucaaugug

SEQ ID NO: 5580 - RNA, 19 nt, artificial
  Oligomer
cacugacucugggaucuca

SEQ ID NO: 5581 - RNA, 19 nt, artificial
  Oligomer
acaaggacuucucugucug

SEQ ID NO: 5582 - RNA, 19 nt, artificial
  Oligomer
agguccacgugaacuugcu

SEQ ID NO: 5583 - RNA, 19 nt, artificial
  Oligomer
accucaaggucuauaucaa

SEQ ID NO: 5584 - RNA, 19 nt, artificial
  Oligomer
gacuacuuuaccagcuucu

SEQ ID NO: 5585 - RNA, 19 nt, artificial
  Oligomer
gaagacccuacuuucggau

SEQ ID NO: 5586 - RNA, 19 nt, artificial
  Oligomer
acccagacaugcugugcuu

SEQ ID NO: 5587 - RNA, 19 nt, artificial
  Oligomer
caccaaggaacacauccag

SEQ ID NO: 5588 - RNA, 19 nt, artificial
  Oligomer
gagccuuucuagauggcuu

SEQ ID NO: 5589 - RNA, 19 nt, artificial
  Oligomer
aaaaaguugagccuuucua

SEQ ID NO: 5590 - RNA, 19 nt, artificial
  Oligomer
gaggaggagagggagaauu

SEQ ID NO: 5591 - RNA, 19 nt, artificial
  Oligomer
cuggucacauugccuucug

SEQ ID NO: 5592 - RNA, 19 nt, artificial
  Oligomer
agauuaucucuagagaguu

SEQ ID NO: 5593 - RNA, 19 nt, artificial
  Oligomer
aguucaguuuuuugacuuc

SEQ ID NO: 5594 - RNA, 19 nt, artificial
  Oligomer
guguccaguucccuaaaag

SEQ ID NO: 5595 - RNA, 19 nt, artificial
  Oligomer
cccaucaaugugaaaguca

SEQ ID NO: 5596 - RNA, 19 nt, artificial
  Oligomer
ucacccaucaaugugaaag

SEQ ID NO: 5597 - RNA, 19 nt, artificial
  Oligomer
ucaguguucuuaccuggua

SEQ ID NO: 5598 - RNA, 19 nt, artificial
  Oligomer
gagcacuuggagauccuaa

SEQ ID NO: 5599 - RNA, 19 nt, artificial
  Oligomer
agagcacuuggagauccua

SEQ ID NO: 5600 - RNA, 19 nt, artificial
  Oligomer
cccgccaucaguguucuua

SEQ ID NO: 5601 - RNA, 19 nt, artificial
  Oligomer
ggacuucucugucuggaga

SEQ ID NO: 5602 - RNA, 19 nt, artificial
  Oligomer
cccacaaggacuucucugu

SEQ ID NO: 5603 - RNA, 19 nt, artificial
  Oligomer
agaauguacaaccucuucu

SEQ ID NO: 5604 - RNA, 19 nt, artificial
  Oligomer
ccgaagaauguacaaccuc

SEQ ID NO: 5605 - RNA, 19 nt, artificial
  Oligomer
caaggucuauaucaagaca

SEQ ID NO: 5606 - RNA, 19 nt, artificial
  Oligomer
gcggaaccucaaggucuau

SEQ ID NO: 5607 - RNA, 19 nt, artificial
  Oligomer
agcggaaccucaaggucua

SEQ ID NO: 5608 - RNA, 19 nt, artificial
  Oligomer
cgucuuuggcaucagauau

SEQ ID NO: 5609 - RNA, 19 nt, artificial
  Oligomer
gacccuacuuucggauaug

SEQ ID NO: 5610 - RNA, 19 nt, artificial
  Oligomer
cuguaaauguucacugggu

SEQ ID NO: 5611 - RNA, 19 nt, artificial
  Oligomer
cugugaauuacgacuucuc

SEQ ID NO: 5612 - RNA, 19 nt, artificial
  Oligomer
cccaguaucucaucugucc

SEQ ID NO: 5613 - RNA, 19 nt, artificial
  Oligomer
ggcuacauugccaaaccuc

SEQ ID NO: 5614 - RNA, 19 nt, artificial
  Oligomer
ucaaggucuauaucaagac

SEQ ID NO: 5615 - RNA, 19 nt, artificial
  Oligomer
cgccacuacauugccauca

SEQ ID NO: 5616 - RNA, 19 nt, artificial
  Oligomer
cccaggauuauaccuggga

SEQ ID NO: 5617 - RNA, 19 nt, artificial
  Oligomer
acccuacuuucggauauga

SEQ ID NO: 5618 - RNA, 19 nt, artificial
  Oligomer
gagcuggagaagucagaga

SEQ ID NO: 5619 - RNA, 19 nt, artificial
  Oligomer
aggaacacauccaggccuu

SEQ ID NO: 5620 - RNA, 19 nt, artificial
  Oligomer
ugccacauuaaauacccgu

SEQ ID NO: 5621 - RNA, 19 nt, artificial
  Oligomer
gugaauuacgacuucucuu

SEQ ID NO: 5622 - RNA, 19 nt, artificial
  Oligomer
ccauuucugcagccagugu

SEQ ID NO: 5623 - RNA, 19 nt, artificial
  Oligomer
ggguucuuguuuggacccu

SEQ ID NO: 5624 - RNA, 19 nt, artificial
  Oligomer
caaaaaguugagccuuucu

SEQ ID NO: 5625 - RNA, 19 nt, artificial
  Oligomer
ggagaauucuguucuccca

SEQ ID NO: 5626 - RNA, 19 nt, artificial
  Oligomer
gcuggucacauugccuucu

SEQ ID NO: 5627 - RNA, 19 nt, artificial
  Oligomer
ucaaggacuaccugcgguu

SEQ ID NO: 5628 - RNA, 19 nt, artificial
  Oligomer
cuaguucaguuuuuugacu

SEQ ID NO: 5629 - RNA, 19 nt, artificial
  Oligomer
uggucuguguguccaguuc

SEQ ID NO: 5630 - RNA, 19 nt, artificial
  Oligomer
ccaucaguguucuuaccug

SEQ ID NO: 5631 - RNA, 19 nt, artificial
  Oligomer
agacccuuuugugucccau

SEQ ID NO: 5632 - RNA, 19 nt, artificial
  Oligomer
agaagaccacccgaagaau

SEQ ID NO: 5633 - RNA, 19 nt, artificial
  Oligomer
gccaucuggaacuauaucc

SEQ ID NO: 5634 - RNA, 19 nt, artificial
  Oligomer
agggacccguugaacaacu

SEQ ID NO: 5635 - RNA, 19 nt, artificial
  Oligomer
uacgacuucucuugcccuu

SEQ ID NO: 5636 - RNA, 19 nt, artificial
  Oligomer
ggcucaucaccaaggaaca

SEQ ID NO: 5637 - RNA, 19 nt, artificial
  Oligomer
acauugccaaaccucugac

SEQ ID NO: 5638 - RNA, 19 nt, artificial
  Oligomer
accauggcuacauugccaa

SEQ ID NO: 5639 - RNA, 19 nt, artificial
  Oligomer
gccuuucuagauggcuuag

SEQ ID NO: 5640 - RNA, 19 nt, artificial
  Oligomer
ucccaaaaaguugagccuu

SEQ ID NO: 5641 - RNA, 19 nt, artificial
  Oligomer
gguccuuuaugcuugaggu

SEQ ID NO: 5642 - RNA, 19 nt, artificial
  Oligomer
gagaguuugagccuuugcu

SEQ ID NO: 5643 - RNA, 19 nt, artificial
  Oligomer
uucaguuuuuugacuuccu

SEQ ID NO: 5644 - RNA, 19 nt, artificial
  Oligomer
ccaguucccuaaaagccug

SEQ ID NO: 5645 - RNA, 19 nt, artificial
  Oligomer
uguguccaguucccuaaaa

SEQ ID NO: 5646 - RNA, 19 nt, artificial
  Oligomer
agcuggaagagcacuugga

SEQ ID NO: 5647 - RNA, 19 nt, artificial
  Oligomer
ucccuuuuccucacuggaa

SEQ ID NO: 5648 - RNA, 19 nt, artificial
  Oligomer
ccacaaggacuucucuguc

SEQ ID NO: 5649 - RNA, 19 nt, artificial
  Oligomer
acaaccucuucuggaggca

SEQ ID NO: 5650 - RNA, 19 nt, artificial
  Oligomer
caucagauaugaugacuau

SEQ ID NO: 5651 - RNA, 19 nt, artificial
  Oligomer
ggcaucagauaugaugacu

SEQ ID NO: 5652 - RNA, 19 nt, artificial
  Oligomer
cacugcgucuuuggcauca

SEQ ID NO: 5653 - RNA, 19 nt, artificial
  Oligomer
cagggccaucuggaacuau

SEQ ID NO: 5654 - RNA, 19 nt, artificial
  Oligomer
ugacuacuuuaccagcuuc

SEQ ID NO: 5655 - RNA, 19 nt, artificial
  Oligomer
ccugacuacuuuaccagcu

SEQ ID NO: 5656 - RNA, 19 nt, artificial
  Oligomer
accauggcuacucgcugau

SEQ ID NO: 5657 - RNA, 19 nt, artificial
  Oligomer
caggauuauaccugggaag

SEQ ID NO: 5658 - RNA, 19 nt, artificial
  Oligomer
cccuacuuucggauaugag

SEQ ID NO: 5659 - RNA, 19 nt, artificial
  Oligomer
ucaccaaggaacacaucca

SEQ ID NO: 5660 - RNA, 19 nt, artificial
  Oligomer
agaauucuguucucccaga

SEQ ID NO: 5661 - RNA, 19 nt, artificial
  Oligomer
cuccaugcuuaauggugug

SEQ ID NO: 5662 - RNA, 19 nt, artificial
  Oligomer
ugcacugacucugggaucu

SEQ ID NO: 5663 - RNA, 19 nt, artificial
  Oligomer
ugaacuugcugcuccugga

SEQ ID NO: 5664 - RNA, 19 nt, artificial
  Oligomer
cggauaugaggacuucacu

SEQ ID NO: 5665 - RNA, 19 nt, artificial
  Oligomer
ucggauaugaggacuucac

SEQ ID NO: 5666 - RNA, 19 nt, artificial
  Oligomer
gcuuuguggaagacccuac

SEQ ID NO: 5667 - RNA, 19 nt, artificial
  Oligomer
ggacccguugaacaacucu

SEQ ID NO: 5668 - RNA, 19 nt, artificial
  Oligomer
uccuucguguuuggcugug

SEQ ID NO: 5669 - RNA, 19 nt, artificial
  Oligomer
caguuuggagggcacugaa

SEQ ID NO: 5670 - RNA, 19 nt, artificial
  Oligomer
uggcucaucaccaaggaac

SEQ ID NO: 5671 - RNA, 19 nt, artificial
  Oligomer
accgauuccaggcacuuuc

SEQ ID NO: 5672 - RNA, 19 nt, artificial
  Oligomer
caacaaguugcuggcgcau

SEQ ID NO: 5673 - RNA, 19 nt, artificial
  Oligomer
ucaacaaguugcuggcgca

SEQ ID NO: 5674 - RNA, 19 nt, artificial
  Oligomer
ccauggcuacauugccaaa

SEQ ID NO: 5675 - RNA, 19 nt, artificial
  Oligomer
gaauucuguucucccagag

SEQ ID NO: 5676 - RNA, 19 nt, artificial
  Oligomer
ugcuugagguuccaaccug

SEQ ID NO: 5677 - RNA, 19 nt, artificial
  Oligomer
gagccuuugcuggucacau

SEQ ID NO: 5678 - RNA, 19 nt, artificial
  Oligomer
cagauuaucucuagagagu

SEQ ID NO: 5679 - RNA, 19 nt, artificial
  Oligomer
gcagauuaucucuagagag

SEQ ID NO: 5680 - RNA, 19 nt, artificial
  Oligomer
ccaugcuuaauggugugag

SEQ ID NO: 5681 - RNA, 19 nt, artificial
  Oligomer
gcccgaauccuaguucagu

SEQ ID NO: 5682 - RNA, 19 nt, artificial
  Oligomer
caaguguuguggccuuccu

SEQ ID NO: 5683 - RNA, 19 nt, artificial
  Oligomer
ucacuggaauggacaguuc

SEQ ID NO: 5684 - RNA, 19 nt, artificial
  Oligomer
gucuuuggcaucagauaug

SEQ ID NO: 5685 - RNA, 19 nt, artificial
  Oligomer
ugcgucuuuggcaucagau

SEQ ID NO: 5686 - RNA, 19 nt, artificial
  Oligomer
cugcgucuuuggcaucaga

SEQ ID NO: 5687 - RNA, 19 nt, artificial
  Oligomer
gccuauagccucaccuaca

SEQ ID NO: 5688 - RNA, 19 nt, artificial
  Oligomer
acccugacuacuuuaccag

SEQ ID NO: 5689 - RNA, 19 nt, artificial
  Oligomer
ggauaugaggacuucacuc

SEQ ID NO: 5690 - RNA, 19 nt, artificial
  Oligomer
cgcuuugagcuggagaagu

SEQ ID NO: 5691 - RNA, 19 nt, artificial
  Oligomer
ugcagaaaucuuuggcuuu

SEQ ID NO: 5692 - RNA, 19 nt, artificial
  Oligomer
gcccuucuucuagcagucu

SEQ ID NO: 5693 - RNA, 19 nt, artificial
  Oligomer
cgauuccaggcacuuucug

SEQ ID NO: 5694 - RNA, 19 nt, artificial
  Oligomer
gaccauggcuacauugcca

SEQ ID NO: 5695 - RNA, 19 nt, artificial
  Oligomer
gguucuuguuuggacccug

SEQ ID NO: 5696 - RNA, 19 nt, artificial
  Oligomer
uggucacauugccuucuga

SEQ ID NO: 5697 - RNA, 19 nt, artificial
  Oligomer
guguguccaguucccuaaa

SEQ ID NO: 5698 - RNA, 19 nt, artificial
  Oligomer
uguguguccaguucccuaa

SEQ ID NO: 5699 - RNA, 19 nt, artificial
  Oligomer
caguguucuuaccugguag

SEQ ID NO: 5700 - RNA, 19 nt, artificial
  Oligomer
cagagcucaaggacuaccu

SEQ ID NO: 5701 - RNA, 19 nt, artificial
  Oligomer
cagacccuuuuguguccca

SEQ ID NO: 5702 - RNA, 19 nt, artificial
  Oligomer
uggcaucagauaugaugac

SEQ ID NO: 5703 - RNA, 19 nt, artificial
  Oligomer
uccacugcgucuuuggcau

SEQ ID NO: 5704 - RNA, 19 nt, artificial
  Oligomer
cuauagccucaccuacaau

SEQ ID NO: 5705 - RNA, 19 nt, artificial
  Oligomer
agaaguuccaggcagccua

SEQ ID NO: 5706 - RNA, 19 nt, artificial
  Oligomer
gaccgauuccaggcacuuu

SEQ ID NO: 5707 - RNA, 19 nt, artificial
  Oligomer
cgagaucaacaaguugcug

SEQ ID NO: 5708 - RNA, 19 nt, artificial
  Oligomer
gagggagaauucuguucuc

SEQ ID NO: 5709 - RNA, 19 nt, artificial
  Oligomer
ccuuccugaacugggaagu

SEQ ID NO: 5710 - RNA, 19 nt, artificial
  Oligomer
cagccuauagccucaccua

SEQ ID NO: 5711 - RNA, 19 nt, artificial
  Oligomer
gaaguuccaggcagccuau

SEQ ID NO: 5712 - RNA, 19 nt, artificial
  Oligomer
ggaugagaaguuccaggca

SEQ ID NO: 5713 - RNA, 19 nt, artificial
  Oligomer
agcucauucaggcucuggu

SEQ ID NO: 5714 - RNA, 19 nt, artificial
  Oligomer
ugcccuucuucuagcaguc

SEQ ID NO: 5715 - RNA, 19 nt, artificial
  Oligomer
cgcaaacucagcgagauca

SEQ ID NO: 5716 - RNA, 19 nt, artificial
  Oligomer
cuggucuguguguccaguu

SEQ ID NO: 5717 - RNA, 19 nt, artificial
  Oligomer
aggcagcuuugccuucucu

SEQ ID NO: 5718 - RNA, 19 nt, artificial
  Oligomer
cacaaguguuguggccuuc

SEQ ID NO: 5719 - RNA, 19 nt, artificial
  Oligomer
uccaugcuuaaugguguga

SEQ ID NO: 5720 - RNA, 19 nt, artificial
  Oligomer
ugcuggaugagaaguucca

SEQ ID NO: 5721 - RNA, 19 nt, artificial
  Oligomer
agcacuuggagauccuaag

SEQ ID NO: 5722 - RNA, 19 nt, artificial
  Oligomer
cucacuggaauggacaguu

SEQ ID NO: 5723 - RNA, 19 nt, artificial
  Oligomer
gcugugcuuuguggaagac

SEQ ID NO: 5724 - RNA, 19 nt, artificial
  Oligomer
ggcacugaagaaaggcaag

SEQ ID NO: 5725 - RNA, 19 nt, artificial
  Oligomer
ccucacuggaauggacagu

SEQ ID NO: 5726 - RNA, 19 nt, artificial
  Oligomer
uuguggcacauuaauuccg

SEQ ID NO: 5727 - RNA, 19 nt, artificial
  Oligomer
aaaaagggcaaaggaaguc

SEQ ID NO: 5728 - RNA, 19 nt, artificial
  Oligomer
auuuaauguggcacacugg

SEQ ID NO: 5729 - RNA, 19 nt, artificial
  Oligomer
guaggagguaaugaaaucu

SEQ ID NO: 5730 - RNA, 19 nt, artificial
  Oligomer
augauggcaauguaguggc

SEQ ID NO: 5731 - RNA, 19 nt, artificial
  Oligomer
uauuuaauguggcacacug

SEQ ID NO: 5732 - RNA, 19 nt, artificial
  Oligomer
aaggaagucaaaaaacuga

SEQ ID NO: 5733 - RNA, 19 nt, artificial
  Oligomer
aaugaaaucuggaaaugac

SEQ ID NO: 5734 - RNA, 19 nt, artificial
  Oligomer
cugcacggguauuuaaugu

SEQ ID NO: 5735 - RNA, 19 nt, artificial
  Oligomer
uuuaauguggcacacuggc

SEQ ID NO: 5736 - RNA, 19 nt, artificial
  Oligomer
aaaauccgcuugcuguugg

SEQ ID NO: 5737 - RNA, 19 nt, artificial
  Oligomer
augggugaauggcaaguag

SEQ ID NO: 5738 - RNA, 19 nt, artificial
  Oligomer
auauaguuccagauggccc

SEQ ID NO: 5739 - RNA, 19 nt, artificial
  Oligomer
cuuuuugggagacaucugc

SEQ ID NO: 5740 - RNA, 19 nt, artificial
  Oligomer
auugaugggugaauggcaa

SEQ ID NO: 5741 - RNA, 19 nt, artificial
  Oligomer
gugaauggcaaguaggagg

SEQ ID NO: 5742 - RNA, 19 nt, artificial
  Oligomer
ugaauggcaaguaggaggu

SEQ ID NO: 5743 - RNA, 19 nt, artificial
  Oligomer
acuuguggcacauuaauuc

SEQ ID NO: 5744 - RNA, 19 nt, artificial
  Oligomer
cuuguggcacauuaauucc

SEQ ID NO: 5745 - RNA, 19 nt, artificial
  Oligomer
ucauauggaacugguagca

SEQ ID NO: 5746 - RNA, 19 nt, artificial
  Oligomer
uucugcacuugaacacugg

SEQ ID NO: 5747 - RNA, 19 nt, artificial
  Oligomer
auuuacagucaucacaugc

SEQ ID NO: 5748 - RNA, 19 nt, artificial
  Oligomer
gaucuugcaagaaaauccg

SEQ ID NO: 5749 - RNA, 19 nt, artificial
  Oligomer
aaggaccaaaauaaagagg

SEQ ID NO: 5750 - RNA, 19 nt, artificial
  Oligomer
aaaaacugaacuaggauuc

SEQ ID NO: 5751 - RNA, 19 nt, artificial
  Oligomer
cugacuuucacauugaugg

SEQ ID NO: 5752 - RNA, 19 nt, artificial
  Oligomer
auuaauuccgagcuuggcc

SEQ ID NO: 5753 - RNA, 19 nt, artificial
  Oligomer
uucucaucauauggaacug

SEQ ID NO: 5754 - RNA, 19 nt, artificial
  Oligomer
auguguuccuuggugauga

SEQ ID NO: 5755 - RNA, 19 nt, artificial
  Oligomer
aagucguaauucacaguca

SEQ ID NO: 5756 - RNA, 19 nt, artificial
  Oligomer
ugaucuugcaagaaaaucc

SEQ ID NO: 5757 - RNA, 19 nt, artificial
  Oligomer
aucuugcaagaaaauccgc

SEQ ID NO: 5758 - RNA, 19 nt, artificial
  Oligomer
uuuuugggagacaucugcg

SEQ ID NO: 5759 - RNA, 19 nt, artificial
  Oligomer
aaaggaccaaaauaaagag

SEQ ID NO: 5760 - RNA, 19 nt, artificial
  Oligomer
aucuaauacucccuccucu

SEQ ID NO: 5761 - RNA, 19 nt, artificial
  Oligomer
aagggaaaaagggcaaagg

SEQ ID NO: 5762 - RNA, 19 nt, artificial
  Oligomer
aaaacugaacuaggauucg

SEQ ID NO: 5763 - RNA, 19 nt, artificial
  Oligomer
aaugaacuguccauuccag

SEQ ID NO: 5764 - RNA, 19 nt, artificial
  Oligomer
uuucucaucauauggaacu

SEQ ID NO: 5765 - RNA, 19 nt, artificial
  Oligomer
guccaaacaagaacccugg

SEQ ID NO: 5766 - RNA, 19 nt, artificial
  Oligomer
aauggcaaguaggagguaa

SEQ ID NO: 5767 - RNA, 19 nt, artificial
  Oligomer
uguggcacauuaauuccga

SEQ ID NO: 5768 - RNA, 19 nt, artificial
  Oligomer
gauauaguuccagauggcc

SEQ ID NO: 5769 - RNA, 19 nt, artificial
  Oligomer
augguauuguaggugaggc

SEQ ID NO: 5770 - RNA, 19 nt, artificial
  Oligomer
agcaaagccaaagauuucu

SEQ ID NO: 5771 - RNA, 19 nt, artificial
  Oligomer
ucacagucauuugcuacag

SEQ ID NO: 5772 - RNA, 19 nt, artificial
  Oligomer
uggcacauuaauuccgagc

SEQ ID NO: 5773 - RNA, 19 nt, artificial
  Oligomer
acauuaauuccgagcuugg

SEQ ID NO: 5774 - RNA, 19 nt, artificial
  Oligomer
cuuuggugcuggacucuuc

SEQ ID NO: 5775 - RNA, 19 nt, artificial
  Oligomer
gucuucccagguauaaucc

SEQ ID NO: 5776 - RNA, 19 nt, artificial
  Oligomer
caaacacgaaggaggagag

SEQ ID NO: 5777 - RNA, 19 nt, artificial
  Oligomer
auggaacugguagcaaagc

SEQ ID NO: 5778 - RNA, 19 nt, artificial
  Oligomer
aagaagggcaagagaaguc

SEQ ID NO: 5779 - RNA, 19 nt, artificial
  Oligomer
auucacagucauuugcuac

SEQ ID NO: 5780 - RNA, 19 nt, artificial
  Oligomer
agaugagauacugggaugg

SEQ ID NO: 5781 - RNA, 19 nt, artificial
  Oligomer
ucuugcaagaaaauccgcu

SEQ ID NO: 5782 - RNA, 19 nt, artificial
  Oligomer
aaacaagaacccuggugcc

SEQ ID NO: 5783 - RNA, 19 nt, artificial
  Oligomer
aauacucccuccucuucag

SEQ ID NO: 5784 - RNA, 19 nt, artificial
  Oligomer
auggagaaaagggaaaaag

SEQ ID NO: 5785 - RNA, 19 nt, artificial
  Oligomer
aaagggaaaaagggcaaag

SEQ ID NO: 5786 - RNA, 19 nt, artificial
  Oligomer
aaaggaagucaaaaaacug

SEQ ID NO: 5787 - RNA, 19 nt, artificial
  Oligomer
cacauuaauuccgagcuug

SEQ ID NO: 5788 - RNA, 19 nt, artificial
  Oligomer
aagacgcaguggauauagu

SEQ ID NO: 5789 - RNA, 19 nt, artificial
  Oligomer
guaaaguagucagggugca

SEQ ID NO: 5790 - RNA, 19 nt, artificial
  Oligomer
acaaagcacagcaugucug

SEQ ID NO: 5791 - RNA, 19 nt, artificial
  Oligomer
uaaaguagucagggugcag

SEQ ID NO: 5792 - RNA, 19 nt, artificial
  Oligomer
cucaucauauggaacuggu

SEQ ID NO: 5793 - RNA, 19 nt, artificial
  Oligomer
gucaucacaugcccucuag

SEQ ID NO: 5794 - RNA, 19 nt, artificial
  Oligomer
cagacugcuagaagaaggg

SEQ ID NO: 5795 - RNA, 19 nt, artificial
  Oligomer
aggaccaaaauaaagagga

SEQ ID NO: 5796 - RNA, 19 nt, artificial
  Oligomer
gcaaugaacuguccauucc

SEQ ID NO: 5797 - RNA, 19 nt, artificial
  Oligomer
ugguaaaguagucagggug

SEQ ID NO: 5798 - RNA, 19 nt, artificial
  Oligomer
ucuuccacaaagcacagca

SEQ ID NO: 5799 - RNA, 19 nt, artificial
  Oligomer
gaacguuuauuucucauca

SEQ ID NO: 5800 - RNA, 19 nt, artificial
  Oligomer
ugaacauuuacagucauca

SEQ ID NO: 5801 - RNA, 19 nt, artificial
  Oligomer
agaaagugccuggaaucgg

SEQ ID NO: 5802 - RNA, 19 nt, artificial
  Oligomer
aagaaaauccgcuugcugu

SEQ ID NO: 5803 - RNA, 19 nt, artificial
  Oligomer
cagcuucagacauuguggg

SEQ ID NO: 5804 - RNA, 19 nt, artificial
  Oligomer
ugccaccuaagccaucuag

SEQ ID NO: 5805 - RNA, 19 nt, artificial
  Oligomer
gaaaagggaaaaagggcaa

SEQ ID NO: 5806 - RNA, 19 nt, artificial
  Oligomer
ucaaaaaacugaacuagga

SEQ ID NO: 5807 - RNA, 19 nt, artificial
  Oligomer
accagucugcagaaacucg

SEQ ID NO: 5808 - RNA, 19 nt, artificial
  Oligomer
aggagguaaugaaaucugg

SEQ ID NO: 5809 - RNA, 19 nt, artificial
  Oligomer
gguaagaacacugauggcg

SEQ ID NO: 5810 - RNA, 19 nt, artificial
  Oligomer
agcgaacguuuauuucuca

SEQ ID NO: 5811 - RNA, 19 nt, artificial
  Oligomer
aaagauuucugcacuugaa

SEQ ID NO: 5812 - RNA, 19 nt, artificial
  Oligomer
cuugaacacuggauaccac

SEQ ID NO: 5813 - RNA, 19 nt, artificial
  Oligomer
augcccucuagaacccaga

SEQ ID NO: 5814 - RNA, 19 nt, artificial
  Oligomer
acugccagguugucuacuc

SEQ ID NO: 5815 - RNA, 19 nt, artificial
  Oligomer
acuuguugaucucgcugag

SEQ ID NO: 5816 - RNA, 19 nt, artificial
  Oligomer
cucuucagaaggcaaugug

SEQ ID NO: 5817 - RNA, 19 nt, artificial
  Oligomer
auuaagcauggagaaaagg

SEQ ID NO: 5818 - RNA, 19 nt, artificial
  Oligomer
cugcacaucacacacaagc

SEQ ID NO: 5819 - RNA, 19 nt, artificial
  Oligomer
ugcacaucacacacaagcc

SEQ ID NO: 5820 - RNA, 19 nt, artificial
  Oligomer
guaagaacacugauggcgg

SEQ ID NO: 5821 - RNA, 19 nt, artificial
  Oligomer
aucacacacaagcccacug

SEQ ID NO: 5822 - RNA, 19 nt, artificial
  Oligomer
aaguccucauauccgaaag

SEQ ID NO: 5823 - RNA, 19 nt, artificial
  Oligomer
cagcgaacguuuauuucuc

SEQ ID NO: 5824 - RNA, 19 nt, artificial
  Oligomer
gcaaagccaaagauuucug

SEQ ID NO: 5825 - RNA, 19 nt, artificial
  Oligomer
acagacugcuagaagaagg

SEQ ID NO: 5826 - RNA, 19 nt, artificial
  Oligomer
ggaaccucaagcauaaagg

SEQ ID NO: 5827 - RNA, 19 nt, artificial
  Oligomer
uucagaaggcaaugugacc

SEQ ID NO: 5828 - RNA, 19 nt, artificial
  Oligomer
aaggcucaaacucucuaga

SEQ ID NO: 5829 - RNA, 19 nt, artificial
  Oligomer
uugaucucgcugaguuugc

SEQ ID NO: 5830 - RNA, 19 nt, artificial
  Oligomer
acccugacuuucacauuga

SEQ ID NO: 5831 - RNA, 19 nt, artificial
  Oligomer
agguaagaacacugauggc

SEQ ID NO: 5832 - RNA, 19 nt, artificial
  Oligomer
aacuucucauccagcagcu

SEQ ID NO: 5833 - RNA, 19 nt, artificial
  Oligomer
aacaaaaccucagcgaacg

SEQ ID NO: 5834 - RNA, 19 nt, artificial
  Oligomer
gaugagauacugggauggg

SEQ ID NO: 5835 - RNA, 19 nt, artificial
  Oligomer
aacaagaacccuggugccu

SEQ ID NO: 5836 - RNA, 19 nt, artificial
  Oligomer
cuucuuuccugugcccucu

SEQ ID NO: 5837 - RNA, 19 nt, artificial
  Oligomer
acaucacacacaagcccac

SEQ ID NO: 5838 - RNA, 19 nt, artificial
  Oligomer
ugguauuguaggugaggcu

SEQ ID NO: 5839 - RNA, 19 nt, artificial
  Oligomer
agaacagaauucucccucu

SEQ ID NO: 5840 - RNA, 19 nt, artificial
  Oligomer
gacccugacuuucacauug

SEQ ID NO: 5841 - RNA, 19 nt, artificial
  Oligomer
gaagcaacccacuuaagcc

SEQ ID NO: 5842 - RNA, 19 nt, artificial
  Oligomer
agaauucucccucuccucc

SEQ ID NO: 5843 - RNA, 19 nt, artificial
  Oligomer
gaacuucucauccagcagc

SEQ ID NO: 5844 - RNA, 19 nt, artificial
  Oligomer
augaaacaaaaccucagcg

SEQ ID NO: 5845 - RNA, 19 nt, artificial
  Oligomer
uugccuuucuucagugccc

SEQ ID NO: 5846 - RNA, 19 nt, artificial
  Oligomer
aaaggcucaacuuuuuggg

SEQ ID NO: 5847 - RNA, 19 nt, artificial
  Oligomer
acgccucacaccauuaagc

SEQ ID NO: 5848 - RNA, 19 nt, artificial
  Oligomer
uuaagcauggagaaaaggg

SEQ ID NO: 5849 - RNA, 19 nt, artificial
  Oligomer
uaagcauggagaaaaggga

SEQ ID NO: 5850 - RNA, 19 nt, artificial
  Oligomer
agaaaagggaaaaagggca

SEQ ID NO: 5851 - RNA, 19 nt, artificial
  Oligomer
aaaagggcaaaggaaguca

SEQ ID NO: 5852 - RNA, 19 nt, artificial
  Oligomer
agugaggaaaagggagggu

SEQ ID NO: 5853 - RNA, 19 nt, artificial
  Oligomer
auauagaccuugagguucc

SEQ ID NO: 5854 - RNA, 19 nt, artificial
  Oligomer
ccuugccuuucuucagugc

SEQ ID NO: 5855 - RNA, 19 nt, artificial
  Oligomer
gagaaaagggaaaaagggc

SEQ ID NO: 5856 - RNA, 19 nt, artificial
  Oligomer
aaaucuggaaaugacaggg

SEQ ID NO: 5857 - RNA, 19 nt, artificial
  Oligomer
gucagugcaaugaacuguc

SEQ ID NO: 5858 - RNA, 19 nt, artificial
  Oligomer
uuucugcacuugaacacug

SEQ ID NO: 5859 - RNA, 19 nt, artificial
  Oligomer
aucucgcugaguuugcgca

SEQ ID NO: 5860 - RNA, 19 nt, artificial
  Oligomer
aaguucacguggaccuucu

SEQ ID NO: 5861 - RNA, 19 nt, artificial
  Oligomer
gauuucugcacuugaacac

SEQ ID NO: 5862 - RNA, 19 nt, artificial
  Oligomer
aacacuggauaccacuccc

SEQ ID NO: 5863 - RNA, 19 nt, artificial
  Oligomer
gaaaggcucaacuuuuugg

SEQ ID NO: 5864 - RNA, 19 nt, artificial
  Oligomer
gacuuucacauugaugggu

SEQ ID NO: 5865 - RNA, 19 nt, artificial
  Oligomer
agucagugcaaugaacugu

SEQ ID NO: 5866 - RNA, 19 nt, artificial
  Oligomer
ucagugcaaugaacugucc

SEQ ID NO: 5867 - RNA, 19 nt, artificial
  Oligomer
auuccagugaggaaaaggg

SEQ ID NO: 5868 - RNA, 19 nt, artificial
  Oligomer
agguuguacauucuucggg

SEQ ID NO: 5869 - RNA, 19 nt, artificial
  Oligomer
acugucuugauauagaccu

SEQ ID NO: 5870 - RNA, 19 nt, artificial
  Oligomer
aagcugguaaaguagucag

SEQ ID NO: 5871 - RNA, 19 nt, artificial
  Oligomer
uucccagguauaauccugg

SEQ ID NO: 5872 - RNA, 19 nt, artificial
  Oligomer
aaagcacagcaugucuggg

SEQ ID NO: 5873 - RNA, 19 nt, artificial
  Oligomer
uuaauguggcacacuggcc

SEQ ID NO: 5874 - RNA, 19 nt, artificial
  Oligomer
uugcuacagaaagugccug

SEQ ID NO: 5875 - RNA, 19 nt, artificial
  Oligomer
aauguagccauggucaccu

SEQ ID NO: 5876 - RNA, 19 nt, artificial
  Oligomer
aaagggcaaaggaagucaa

SEQ ID NO: 5877 - RNA, 19 nt, artificial
  Oligomer
aaagcugccuggaguguca

SEQ ID NO: 5878 - RNA, 19 nt, artificial
  Oligomer
agagguuguacauucuucg

SEQ ID NO: 5879 - RNA, 19 nt, artificial
  Oligomer
uauagaccuugagguuccg

SEQ ID NO: 5880 - RNA, 19 nt, artificial
  Oligomer
uaucugaugccaaagacgc

SEQ ID NO: 5881 - RNA, 19 nt, artificial
  Oligomer
auggcgaugguauuguagg

SEQ ID NO: 5882 - RNA, 19 nt, artificial
  Oligomer
aagccaaagauuucugcac

SEQ ID NO: 5883 - RNA, 19 nt, artificial
  Oligomer
acacuggauaccacucccu

SEQ ID NO: 5884 - RNA, 19 nt, artificial
  Oligomer
ugcacggguauuuaaugug

SEQ ID NO: 5885 - RNA, 19 nt, artificial
  Oligomer
gcacggguauuuaaugugg

SEQ ID NO: 5886 - RNA, 19 nt, artificial
  Oligomer
uuugcuacagaaagugccu

SEQ ID NO: 5887 - RNA, 19 nt, artificial
  Oligomer
aaacugaacuaggauucgg

SEQ ID NO: 5888 - RNA, 19 nt, artificial
  Oligomer
aacugaacuaggauucggg

SEQ ID NO: 5889 - RNA, 19 nt, artificial
  Oligomer
aacagaacaggcuuuuagg

SEQ ID NO: 5890 - RNA, 19 nt, artificial
  Oligomer
acagaacaggcuuuuaggg

SEQ ID NO: 5891 - RNA, 19 nt, artificial
  Oligomer
aggagcagcaaguucacgu

SEQ ID NO: 5892 - RNA, 19 nt, artificial
  Oligomer
aagagguuguacauucuuc

SEQ ID NO: 5893 - RNA, 19 nt, artificial
  Oligomer
acgcaguggauauaguucc

SEQ ID NO: 5894 - RNA, 19 nt, artificial
  Oligomer
uggauauaguuccagaugg

SEQ ID NO: 5895 - RNA, 19 nt, artificial
  Oligomer
uggcgaugguauuguaggu

SEQ ID NO: 5896 - RNA, 19 nt, artificial
  Oligomer
aaaguagggucuuccacaa

SEQ ID NO: 5897 - RNA, 19 nt, artificial
  Oligomer
ugaaacaaaaccucagcga

SEQ ID NO: 5898 - RNA, 19 nt, artificial
  Oligomer
uggaacugguagcaaagcc

SEQ ID NO: 5899 - RNA, 19 nt, artificial
  Oligomer
auuucugcacuugaacacu

SEQ ID NO: 5900 - RNA, 19 nt, artificial
  Oligomer
cacggguauuuaauguggc

SEQ ID NO: 5901 - RNA, 19 nt, artificial
  Oligomer
uaauguggcacacuggcca

SEQ ID NO: 5902 - RNA, 19 nt, artificial
  Oligomer
cauuugcuacagaaagugc

SEQ ID NO: 5903 - RNA, 19 nt, artificial
  Oligomer
auguagccauggucaccug

SEQ ID NO: 5904 - RNA, 19 nt, artificial
  Oligomer
agcaacuuguugaucucgc

SEQ ID NO: 5905 - RNA, 19 nt, artificial
  Oligomer
caaugugaccagcaaaggc

SEQ ID NO: 5906 - RNA, 19 nt, artificial
  Oligomer
acuuucacauugaugggug

SEQ ID NO: 5907 - RNA, 19 nt, artificial
  Oligomer
acauugaugggugaauggc

SEQ ID NO: 5908 - RNA, 19 nt, artificial
  Oligomer
gaaaucuggaaaugacagg

SEQ ID NO: 5909 - RNA, 19 nt, artificial
  Oligomer
aaggccacaacacuugugg

SEQ ID NO: 5910 - RNA, 19 nt, artificial
  Oligomer
uuguacauucuucgggugg

SEQ ID NO: 5911 - RNA, 19 nt, artificial
  Oligomer
uagucaucauaucugaugc

SEQ ID NO: 5912 - RNA, 19 nt, artificial
  Oligomer
uccgaaaguagggucuucc

SEQ ID NO: 5913 - RNA, 19 nt, artificial
  Oligomer
uuuggugcuggacucuucc

SEQ ID NO: 5914 - RNA, 19 nt, artificial
  Oligomer
cagugaacauuuacaguca

SEQ ID NO: 5915 - RNA, 19 nt, artificial
  Oligomer
uugcaagaaaauccgcuug

SEQ ID NO: 5916 - RNA, 19 nt, artificial
  Oligomer
ugcaagaaaauccgcuugc

SEQ ID NO: 5917 - RNA, 19 nt, artificial
  Oligomer
agguuuggcaauguagcca

SEQ ID NO: 5918 - RNA, 19 nt, artificial
  Oligomer
uaagccaucuagaaaggcu

SEQ ID NO: 5919 - RNA, 19 nt, artificial
  Oligomer
aggcucaacuuuuugggag

SEQ ID NO: 5920 - RNA, 19 nt, artificial
  Oligomer
aacuuuuugggagacaucu

SEQ ID NO: 5921 - RNA, 19 nt, artificial
  Oligomer
aaccucaagcauaaaggac

SEQ ID NO: 5922 - RNA, 19 nt, artificial
  Oligomer
aaacucucuagagauaauc

SEQ ID NO: 5923 - RNA, 19 nt, artificial
  Oligomer
cacauugaugggugaaugg

SEQ ID NO: 5924 - RNA, 19 nt, artificial
  Oligomer
ugagaucccagagucagug

SEQ ID NO: 5925 - RNA, 19 nt, artificial
  Oligomer
cagacagagaaguccuugu

SEQ ID NO: 5926 - RNA, 19 nt, artificial
  Oligomer
agcaaguucacguggaccu

SEQ ID NO: 5927 - RNA, 19 nt, artificial
  Oligomer
uugauauagaccuugaggu

SEQ ID NO: 5928 - RNA, 19 nt, artificial
  Oligomer
agaagcugguaaaguaguc

SEQ ID NO: 5929 - RNA, 19 nt, artificial
  Oligomer
auccgaaaguagggucuuc

SEQ ID NO: 5930 - RNA, 19 nt, artificial
  Oligomer
aagcacagcaugucugggu

SEQ ID NO: 5931 - RNA, 19 nt, artificial
  Oligomer
cuggauguguuccuuggug

SEQ ID NO: 5932 - RNA, 19 nt, artificial
  Oligomer
aagccaucuagaaaggcuc

SEQ ID NO: 5933 - RNA, 19 nt, artificial
  Oligomer
uagaaaggcucaacuuuuu

SEQ ID NO: 5934 - RNA, 19 nt, artificial
  Oligomer
aauucucccucuccuccuc

SEQ ID NO: 5935 - RNA, 19 nt, artificial
  Oligomer
cagaaggcaaugugaccag

SEQ ID NO: 5936 - RNA, 19 nt, artificial
  Oligomer
aacucucuagagauaaucu

SEQ ID NO: 5937 - RNA, 19 nt, artificial
  Oligomer
gaagucaaaaaacugaacu

SEQ ID NO: 5938 - RNA, 19 nt, artificial
  Oligomer
cuuuuagggaacuggacac

SEQ ID NO: 5939 - RNA, 19 nt, artificial
  Oligomer
ugacuuucacauugauggg

SEQ ID NO: 5940 - RNA, 19 nt, artificial
  Oligomer
cuuucacauugauggguga

SEQ ID NO: 5941 - RNA, 19 nt, artificial
  Oligomer
uaccagguaagaacacuga

SEQ ID NO: 5942 - RNA, 19 nt, artificial
  Oligomer
uuaggaucuccaagugcuc

SEQ ID NO: 5943 - RNA, 19 nt, artificial
  Oligomer
uaggaucuccaagugcucu

SEQ ID NO: 5944 - RNA, 19 nt, artificial
  Oligomer
uaagaacacugauggcggg

SEQ ID NO: 5945 - RNA, 19 nt, artificial
  Oligomer
ucuccagacagagaagucc

SEQ ID NO: 5946 - RNA, 19 nt, artificial
  Oligomer
acagagaaguccuuguggg

SEQ ID NO: 5947 - RNA, 19 nt, artificial
  Oligomer
agaagagguuguacauucu

SEQ ID NO: 5948 - RNA, 19 nt, artificial
  Oligomer
gagguuguacauucuucgg

SEQ ID NO: 5949 - RNA, 19 nt, artificial
  Oligomer
ugucuugauauagaccuug

SEQ ID NO: 5950 - RNA, 19 nt, artificial
  Oligomer
auagaccuugagguuccgc

SEQ ID NO: 5951 - RNA, 19 nt, artificial
  Oligomer
uagaccuugagguuccgcu

SEQ ID NO: 5952 - RNA, 19 nt, artificial
  Oligomer
auaucugaugccaaagacg

SEQ ID NO: 5953 - RNA, 19 nt, artificial
  Oligomer
cauauccgaaaguaggguc

SEQ ID NO: 5954 - RNA, 19 nt, artificial
  Oligomer
acccagugaacauuuacag

SEQ ID NO: 5955 - RNA, 19 nt, artificial
  Oligomer
gagaagucguaauucacag

SEQ ID NO: 5956 - RNA, 19 nt, artificial
  Oligomer
ggacagaugagauacuggg

SEQ ID NO: 5957 - RNA, 19 nt, artificial
  Oligomer
gagguuuggcaauguagcc

SEQ ID NO: 5958 - RNA, 19 nt, artificial
  Oligomer
gucuugauauagaccuuga

SEQ ID NO: 5959 - RNA, 19 nt, artificial
  Oligomer
ugauggcaauguaguggcg

SEQ ID NO: 5960 - RNA, 19 nt, artificial
  Oligomer
ucccagguauaauccuggg

SEQ ID NO: 5961 - RNA, 19 nt, artificial
  Oligomer
ucauauccgaaaguagggu

SEQ ID NO: 5962 - RNA, 19 nt, artificial
  Oligomer
ucucugacuucuccagcuc

SEQ ID NO: 5963 - RNA, 19 nt, artificial
  Oligomer
aaggccuggauguguuccu

SEQ ID NO: 5964 - RNA, 19 nt, artificial
  Oligomer
acggguauuuaauguggca

SEQ ID NO: 5965 - RNA, 19 nt, artificial
  Oligomer
aagagaagucguaauucac

SEQ ID NO: 5966 - RNA, 19 nt, artificial
  Oligomer
acacuggcugcagaaaugg

SEQ ID NO: 5967 - RNA, 19 nt, artificial
  Oligomer
aggguccaaacaagaaccc

SEQ ID NO: 5968 - RNA, 19 nt, artificial
  Oligomer
agaaaggcucaacuuuuug

SEQ ID NO: 5969 - RNA, 19 nt, artificial
  Oligomer
ugggagaacagaauucucc

SEQ ID NO: 5970 - RNA, 19 nt, artificial
  Oligomer
agaaggcaaugugaccagc

SEQ ID NO: 5971 - RNA, 19 nt, artificial
  Oligomer
aaccgcagguaguccuuga

SEQ ID NO: 5972 - RNA, 19 nt, artificial
  Oligomer
agucaaaaaacugaacuag

SEQ ID NO: 5973 - RNA, 19 nt, artificial
  Oligomer
gaacuggacacacagacca

SEQ ID NO: 5974 - RNA, 19 nt, artificial
  Oligomer
cagguaagaacacugaugg

SEQ ID NO: 5975 - RNA, 19 nt, artificial
  Oligomer
augggacacaaaagggucu

SEQ ID NO: 5976 - RNA, 19 nt, artificial
  Oligomer
auucuucggguggucuucu

SEQ ID NO: 5977 - RNA, 19 nt, artificial
  Oligomer
ggauauaguuccagauggc

SEQ ID NO: 5978 - RNA, 19 nt, artificial
  Oligomer
aguuguucaacgggucccu

SEQ ID NO: 5979 - RNA, 19 nt, artificial
  Oligomer
aagggcaagagaagucgua

SEQ ID NO: 5980 - RNA, 19 nt, artificial
  Oligomer
uguuccuuggugaugagcc

SEQ ID NO: 5981 - RNA, 19 nt, artificial
  Oligomer
gucagagguuuggcaaugu

SEQ ID NO: 5982 - RNA, 19 nt, artificial
  Oligomer
uuggcaauguagccauggu

SEQ ID NO: 5983 - RNA, 19 nt, artificial
  Oligomer
cuaagccaucuagaaaggc

SEQ ID NO: 5984 - RNA, 19 nt, artificial
  Oligomer
aaggcucaacuuuuuggga

SEQ ID NO: 5985 - RNA, 19 nt, artificial
  Oligomer
accucaagcauaaaggacc

SEQ ID NO: 5986 - RNA, 19 nt, artificial
  Oligomer
agcaaaggcucaaacucuc

SEQ ID NO: 5987 - RNA, 19 nt, artificial
  Oligomer
aggaagucaaaaaacugaa

SEQ ID NO: 5988 - RNA, 19 nt, artificial
  Oligomer
caggcuuuuagggaacugg

SEQ ID NO: 5989 - RNA, 19 nt, artificial
  Oligomer
uuuuagggaacuggacaca

SEQ ID NO: 5990 - RNA, 19 nt, artificial
  Oligomer
uccaagugcucuuccagcu

SEQ ID NO: 5991 - RNA, 19 nt, artificial
  Oligomer
uuccagugaggaaaaggga

SEQ ID NO: 5992 - RNA, 19 nt, artificial
  Oligomer
gacagagaaguccuugugg

SEQ ID NO: 5993 - RNA, 19 nt, artificial
  Oligomer
ugccuccagaagagguugu

SEQ ID NO: 5994 - RNA, 19 nt, artificial
  Oligomer
auagucaucauaucugaug

SEQ ID NO: 5995 - RNA, 19 nt, artificial
  Oligomer
agucaucauaucugaugcc

SEQ ID NO: 5996 - RNA, 19 nt, artificial
  Oligomer
ugaugccaaagacgcagug

SEQ ID NO: 5997 - RNA, 19 nt, artificial
  Oligomer
auaguuccagauggcccug

SEQ ID NO: 5998 - RNA, 19 nt, artificial
  Oligomer
gaagcugguaaaguaguca

SEQ ID NO: 5999 - RNA, 19 nt, artificial
  Oligomer
agcugguaaaguagucagg

SEQ ID NO: 6000 - RNA, 19 nt, artificial
  Oligomer
aucagcgaguagccauggu

SEQ ID NO: 6001 - RNA, 19 nt, artificial
  Oligomer
cuucccagguauaauccug

SEQ ID NO: 6002 - RNA, 19 nt, artificial
  Oligomer
cucauauccgaaaguaggg

SEQ ID NO: 6003 - RNA, 19 nt, artificial
  Oligomer
uggauguguuccuugguga

SEQ ID NO: 6004 - RNA, 19 nt, artificial
  Oligomer
ucugggagaacagaauucu

SEQ ID NO: 6005 - RNA, 19 nt, artificial
  Oligomer
cacaccauuaagcauggag

SEQ ID NO: 6006 - RNA, 19 nt, artificial
  Oligomer
agaucccagagucagugca

SEQ ID NO: 6007 - RNA, 19 nt, artificial
  Oligomer
uccaggagcagcaaguuca

SEQ ID NO: 6008 - RNA, 19 nt, artificial
  Oligomer
agugaaguccucauauccg

SEQ ID NO: 6009 - RNA, 19 nt, artificial
  Oligomer
gugaaguccucauauccga

SEQ ID NO: 6010 - RNA, 19 nt, artificial
  Oligomer
guagggucuuccacaaagc

SEQ ID NO: 6011 - RNA, 19 nt, artificial
  Oligomer
agaguuguucaacgggucc

SEQ ID NO: 6012 - RNA, 19 nt, artificial
  Oligomer
cacagccaaacacgaagga

SEQ ID NO: 6013 - RNA, 19 nt, artificial
  Oligomer
uucagugcccuccaaacug

SEQ ID NO: 6014 - RNA, 19 nt, artificial
  Oligomer
guuccuuggugaugagcca

SEQ ID NO: 6015 - RNA, 19 nt, artificial
  Oligomer
gaaagugccuggaaucggu

SEQ ID NO: 6016 - RNA, 19 nt, artificial
  Oligomer
augcgccagcaacuuguug

SEQ ID NO: 6017 - RNA, 19 nt, artificial
  Oligomer
ugcgccagcaacuuguuga

SEQ ID NO: 6018 - RNA, 19 nt, artificial
  Oligomer
uuuggcaauguagccaugg

SEQ ID NO: 6019 - RNA, 19 nt, artificial
  Oligomer
cucugggagaacagaauuc

SEQ ID NO: 6020 - RNA, 19 nt, artificial
  Oligomer
cagguuggaaccucaagca

SEQ ID NO: 6021 - RNA, 19 nt, artificial
  Oligomer
augugaccagcaaaggcuc

SEQ ID NO: 6022 - RNA, 19 nt, artificial
  Oligomer
acucucuagagauaaucug

SEQ ID NO: 6023 - RNA, 19 nt, artificial
  Oligomer
cucucuagagauaaucugc

SEQ ID NO: 6024 - RNA, 19 nt, artificial
  Oligomer
cucacaccauuaagcaugg

SEQ ID NO: 6025 - RNA, 19 nt, artificial
  Oligomer
acugaacuaggauucgggc

SEQ ID NO: 6026 - RNA, 19 nt, artificial
  Oligomer
aggaaggccacaacacuug

SEQ ID NO: 6027 - RNA, 19 nt, artificial
  Oligomer
gaacuguccauuccaguga

SEQ ID NO: 6028 - RNA, 19 nt, artificial
  Oligomer
cauaucugaugccaaagac

SEQ ID NO: 6029 - RNA, 19 nt, artificial
  Oligomer
aucugaugccaaagacgca

SEQ ID NO: 6030 - RNA, 19 nt, artificial
  Oligomer
ucugaugccaaagacgcag

SEQ ID NO: 6031 - RNA, 19 nt, artificial
  Oligomer
uguaggugaggcuauaggc

SEQ ID NO: 6032 - RNA, 19 nt, artificial
  Oligomer
cugguaaaguagucagggu

SEQ ID NO: 6033 - RNA, 19 nt, artificial
  Oligomer
gagugaaguccucauaucc

SEQ ID NO: 6034 - RNA, 19 nt, artificial
  Oligomer
acuucuccagcucaaagcg

SEQ ID NO: 6035 - RNA, 19 nt, artificial
  Oligomer
aaagccaaagauuucugca

SEQ ID NO: 6036 - RNA, 19 nt, artificial
  Oligomer
agacugcuagaagaagggc

SEQ ID NO: 6037 - RNA, 19 nt, artificial
  Oligomer
cagaaagugccuggaaucg

SEQ ID NO: 6038 - RNA, 19 nt, artificial
  Oligomer
uggcaauguagccaugguc

SEQ ID NO: 6039 - RNA, 19 nt, artificial
  Oligomer
caggguccaaacaagaacc

SEQ ID NO: 6040 - RNA, 19 nt, artificial
  Oligomer
ucagaaggcaaugugacca

SEQ ID NO: 6041 - RNA, 19 nt, artificial
  Oligomer
uuuagggaacuggacacac

SEQ ID NO: 6042 - RNA, 19 nt, artificial
  Oligomer
uuagggaacuggacacaca

SEQ ID NO: 6043 - RNA, 19 nt, artificial
  Oligomer
cuaccagguaagaacacug

SEQ ID NO: 6044 - RNA, 19 nt, artificial
  Oligomer
agguaguccuugagcucug

SEQ ID NO: 6045 - RNA, 19 nt, artificial
  Oligomer
ugggacacaaaagggucug

SEQ ID NO: 6046 - RNA, 19 nt, artificial
  Oligomer
gucaucauaucugaugcca

SEQ ID NO: 6047 - RNA, 19 nt, artificial
  Oligomer
augccaaagacgcagugga

SEQ ID NO: 6048 - RNA, 19 nt, artificial
  Oligomer
auuguaggugaggcuauag

SEQ ID NO: 6049 - RNA, 19 nt, artificial
  Oligomer
uaggcugccuggaacuucu

SEQ ID NO: 6050 - RNA, 19 nt, artificial
  Oligomer
aaagugccuggaaucgguc

SEQ ID NO: 6051 - RNA, 19 nt, artificial
  Oligomer
cagcaacuuguugaucucg

SEQ ID NO: 6052 - RNA, 19 nt, artificial
  Oligomer
gagaacagaauucucccuc

SEQ ID NO: 6053 - RNA, 19 nt, artificial
  Oligomer
acuucccaguucaggaagg

SEQ ID NO: 6054 - RNA, 19 nt, artificial
  Oligomer
uaggugaggcuauaggcug

SEQ ID NO: 6055 - RNA, 19 nt, artificial
  Oligomer
auaggcugccuggaacuuc

SEQ ID NO: 6056 - RNA, 19 nt, artificial
  Oligomer
ugccuggaacuucucaucc

SEQ ID NO: 6057 - RNA, 19 nt, artificial
  Oligomer
accagagccugaaugagcu

SEQ ID NO: 6058 - RNA, 19 nt, artificial
  Oligomer
gacugcuagaagaagggca

SEQ ID NO: 6059 - RNA, 19 nt, artificial
  Oligomer
ugaucucgcugaguuugcg

SEQ ID NO: 6060 - RNA, 19 nt, artificial
  Oligomer
aacuggacacacagaccag

SEQ ID NO: 6061 - RNA, 19 nt, artificial
  Oligomer
agagaaggcaaagcugccu

SEQ ID NO: 6062 - RNA, 19 nt, artificial
  Oligomer
gaaggccacaacacuugug

SEQ ID NO: 6063 - RNA, 19 nt, artificial
  Oligomer
ucacaccauuaagcaugga

SEQ ID NO: 6064 - RNA, 19 nt, artificial
  Oligomer
uggaacuucucauccagca

SEQ ID NO: 6065 - RNA, 19 nt, artificial
  Oligomer
cuuaggaucuccaagugcu

SEQ ID NO: 6066 - RNA, 19 nt, artificial
  Oligomer
aacuguccauuccagugag

SEQ ID NO: 6067 - RNA, 19 nt, artificial
  Oligomer
gucuuccacaaagcacagc

SEQ ID NO: 6068 - RNA, 19 nt, artificial
  Oligomer
cuugccuuucuucagugcc

SEQ ID NO: 6069 - RNA, 19 nt, artificial
  Oligomer
acuguccauuccagugagg

SEQ ID NO: 6070 - RNA, 21 nt, artificial
  Oligomer
ggagggaguauuagauuauaa

SEQ ID NO: 6071 - RNA, 21 nt, artificial
  Oligomer
agauuucauuaccuccuacuu

SEQ ID NO: 6072 - RNA, 21 nt, artificial
  Oligomer
ggaauuaaugugccacaagug

SEQ ID NO: 6073 - RNA, 21 nt, artificial
  Oligomer
ccaguuccauaugaugagaaa

SEQ ID NO: 6074 - RNA, 21 nt, artificial
  Oligomer
ccagugugccacauuaaauac

SEQ ID NO: 6075 - RNA, 21 nt, artificial
  Oligomer
gggcaugugaugacuguaaau

SEQ ID NO: 6076 - RNA, 21 nt, artificial
  Oligomer
gccagugugccacauuaaaua

SEQ ID NO: 6077 - RNA, 21 nt, artificial
  Oligomer
gccgcagaugucucccaaaaa

SEQ ID NO: 6078 - RNA, 21 nt, artificial
  Oligomer
ccucuuuauuuugguccuuua

SEQ ID NO: 6079 - RNA, 21 nt, artificial
  Oligomer
cgaauccuaguucaguuuuuu

SEQ ID NO: 6080 - RNA, 21 nt, artificial
  Oligomer
cuacaugaccugacuccugag

SEQ ID NO: 6081 - RNA, 21 nt, artificial
  Oligomer
gaggagggaguauuagauuau

SEQ ID NO: 6082 - RNA, 21 nt, artificial
  Oligomer
ccuuugcccuuuuucccuuuu

SEQ ID NO: 6083 - RNA, 21 nt, artificial
  Oligomer
cuacuugccauucacccauca

SEQ ID NO: 6084 - RNA, 21 nt, artificial
  Oligomer
gcagaaaucuuuggcuuugcu

SEQ ID NO: 6085 - RNA, 21 nt, artificial
  Oligomer
guagcaaaugacugugaauua

SEQ ID NO: 6086 - RNA, 21 nt, artificial
  Oligomer
uccuuugcccuuuuucccuuu

SEQ ID NO: 6087 - RNA, 21 nt, artificial
  Oligomer
cggaauuaaugugccacaagu

SEQ ID NO: 6088 - RNA, 21 nt, artificial
  Oligomer
ccauaugaugagaaauaaacg

SEQ ID NO: 6089 - RNA, 21 nt, artificial
  Oligomer
caguuccauaugaugagaaau

SEQ ID NO: 6090 - RNA, 21 nt, artificial
  Oligomer
gcaugugaugacuguaaaugu

SEQ ID NO: 6091 - RNA, 21 nt, artificial
  Oligomer
cuguagcaaaugacugugaau

SEQ ID NO: 6092 - RNA, 21 nt, artificial
  Oligomer
gcggauuuucuugcaagauca

SEQ ID NO: 6093 - RNA, 21 nt, artificial
  Oligomer
gcucaucaccaaggaacacau

SEQ ID NO: 6094 - RNA, 21 nt, artificial
  Oligomer
aggagggaguauuagauuaua

SEQ ID NO: 6095 - RNA, 21 nt, artificial
  Oligomer
uacuugccauucacccaucaa

SEQ ID NO: 6096 - RNA, 21 nt, artificial
  Oligomer
ccuacuugccauucacccauc

SEQ ID NO: 6097 - RNA, 21 nt, artificial
  Oligomer
cauuaccuccuacuugccauu

SEQ ID NO: 6098 - RNA, 21 nt, artificial
  Oligomer
ucauuaccuccuacuugccau

SEQ ID NO: 6099 - RNA, 21 nt, artificial
  Oligomer
ucauuuccagauuucauuacc

SEQ ID NO: 6100 - RNA, 21 nt, artificial
  Oligomer
ucggaauuaaugugccacaag

SEQ ID NO: 6101 - RNA, 21 nt, artificial
  Oligomer
cucggaauuaaugugccacaa

SEQ ID NO: 6102 - RNA, 21 nt, artificial
  Oligomer
uugcuaccaguuccauaugau

SEQ ID NO: 6103 - RNA, 21 nt, artificial
  Oligomer
gcuuugcuaccaguuccauau

SEQ ID NO: 6104 - RNA, 21 nt, artificial
  Oligomer
cagaaaucuuuggcuuugcua

SEQ ID NO: 6105 - RNA, 21 nt, artificial
  Oligomer
cgcagaugucucccaaaaagu

SEQ ID NO: 6106 - RNA, 21 nt, artificial
  Oligomer
uccucuuuauuuugguccuuu

SEQ ID NO: 6107 - RNA, 21 nt, artificial
  Oligomer
acaugaccugacuccugagca

SEQ ID NO: 6108 - RNA, 21 nt, artificial
  Oligomer
accaguuccauaugaugagaa

SEQ ID NO: 6109 - RNA, 21 nt, artificial
  Oligomer
agggcaugugaugacuguaaa

SEQ ID NO: 6110 - RNA, 21 nt, artificial
  Oligomer
ggguucuagagggcaugugau

SEQ ID NO: 6111 - RNA, 21 nt, artificial
  Oligomer
gcaaaugacugugaauuacga

SEQ ID NO: 6112 - RNA, 21 nt, artificial
  Oligomer
cggauuuucuugcaagaucag

SEQ ID NO: 6113 - RNA, 21 nt, artificial
  Oligomer
gcagaugucucccaaaaaguu

SEQ ID NO: 6114 - RNA, 21 nt, artificial
  Oligomer
ccuuuaugcuugagguuccaa

SEQ ID NO: 6115 - RNA, 21 nt, artificial
  Oligomer
caaaugacugugaauuacgac

SEQ ID NO: 6116 - RNA, 21 nt, artificial
  Oligomer
ucuguagcaaaugacugugaa

SEQ ID NO: 6117 - RNA, 21 nt, artificial
  Oligomer
ccuuucuagauggcuuaggug

SEQ ID NO: 6118 - RNA, 21 nt, artificial
  Oligomer
agaggagggaguauuagauua

SEQ ID NO: 6119 - RNA, 21 nt, artificial
  Oligomer
gaagaggagggaguauuagau

SEQ ID NO: 6120 - RNA, 21 nt, artificial
  Oligomer
ggccaagcucggaauuaaugu

SEQ ID NO: 6121 - RNA, 21 nt, artificial
  Oligomer
aacuauauccacugcgucuuu

SEQ ID NO: 6122 - RNA, 21 nt, artificial
  Oligomer
gaacuauauccacugcgucuu

SEQ ID NO: 6123 - RNA, 21 nt, artificial
  Oligomer
agacaugcugugcuuugugga

SEQ ID NO: 6124 - RNA, 21 nt, artificial
  Oligomer
uggguucuagagggcauguga

SEQ ID NO: 6125 - RNA, 21 nt, artificial
  Oligomer
caagaaggugugcaggagaga

SEQ ID NO: 6126 - RNA, 21 nt, artificial
  Oligomer
ucgcucuccuccuucguguuu

SEQ ID NO: 6127 - RNA, 21 nt, artificial
  Oligomer
ccuuuuucccuuuucuccaug

SEQ ID NO: 6128 - RNA, 21 nt, artificial
  Oligomer
ccgccaucaguguucuuaccu

SEQ ID NO: 6129 - RNA, 21 nt, artificial
  Oligomer
gaaauaaacguucgcugaggu

SEQ ID NO: 6130 - RNA, 21 nt, artificial
  Oligomer
agagggcaugugaugacugua

SEQ ID NO: 6131 - RNA, 21 nt, artificial
  Oligomer
gaaggugugcaggagagaaga

SEQ ID NO: 6132 - RNA, 21 nt, artificial
  Oligomer
cucaucaccaaggaacacauc

SEQ ID NO: 6133 - RNA, 21 nt, artificial
  Oligomer
gcaccaggguucuuguuugga

SEQ ID NO: 6134 - RNA, 21 nt, artificial
  Oligomer
ccgcagaugucucccaaaaag

SEQ ID NO: 6135 - RNA, 21 nt, artificial
  Oligomer
auccucuuuauuuugguccuu

SEQ ID NO: 6136 - RNA, 21 nt, artificial
  Oligomer
gcucggaauuaaugugccaca

SEQ ID NO: 6137 - RNA, 21 nt, artificial
  Oligomer
ccaagcucggaauuaaugugc

SEQ ID NO: 6138 - RNA, 21 nt, artificial
  Oligomer
gccaagcucggaauuaaugug

SEQ ID NO: 6139 - RNA, 21 nt, artificial
  Oligomer
gggccaagcucggaauuaaug

SEQ ID NO: 6140 - RNA, 21 nt, artificial
  Oligomer
ggcuugugugugaugugcagu

SEQ ID NO: 6141 - RNA, 21 nt, artificial
  Oligomer
ugagaaauaaacguucgcuga

SEQ ID NO: 6142 - RNA, 21 nt, artificial
  Oligomer
aagcggauuuucuugcaagau

SEQ ID NO: 6143 - RNA, 21 nt, artificial
  Oligomer
caacagcaagcggauuuucuu

SEQ ID NO: 6144 - RNA, 21 nt, artificial
  Oligomer
ccaacagcaagcggauuuucu

SEQ ID NO: 6145 - RNA, 21 nt, artificial
  Oligomer
ucaguuuuuugacuuccuuug

SEQ ID NO: 6146 - RNA, 21 nt, artificial
  Oligomer
gaauccuaguucaguuuuuug

SEQ ID NO: 6147 - RNA, 21 nt, artificial
  Oligomer
gcagcugcuggaugagaaguu

SEQ ID NO: 6148 - RNA, 21 nt, artificial
  Oligomer
acguucgcugagguuuuguuu

SEQ ID NO: 6149 - RNA, 21 nt, artificial
  Oligomer
aaauaaacguucgcugagguu

SEQ ID NO: 6150 - RNA, 21 nt, artificial
  Oligomer
ggcaugugaugacuguaaaug

SEQ ID NO: 6151 - RNA, 21 nt, artificial
  Oligomer
cuagagggcaugugaugacug

SEQ ID NO: 6152 - RNA, 21 nt, artificial
  Oligomer
ugccgcagaugucucccaaaa

SEQ ID NO: 6153 - RNA, 21 nt, artificial
  Oligomer
caguuuuuugacuuccuuugc

SEQ ID NO: 6154 - RNA, 21 nt, artificial
  Oligomer
ugggcuugugugugaugugca

SEQ ID NO: 6155 - RNA, 21 nt, artificial
  Oligomer
guaaauguucacugggugggu

SEQ ID NO: 6156 - RNA, 21 nt, artificial
  Oligomer
cccuucuucuagcagucugug

SEQ ID NO: 6157 - RNA, 21 nt, artificial
  Oligomer
ggagagggagaauucuguucu

SEQ ID NO: 6158 - RNA, 21 nt, artificial
  Oligomer
cucagcgagaucaacaaguug

SEQ ID NO: 6159 - RNA, 21 nt, artificial
  Oligomer
ccagauuucauuaccuccuac

SEQ ID NO: 6160 - RNA, 21 nt, artificial
  Oligomer
cucagagaagguccacgugaa

SEQ ID NO: 6161 - RNA, 21 nt, artificial
  Oligomer
guauccaguguucaagugcag

SEQ ID NO: 6162 - RNA, 21 nt, artificial
  Oligomer
gagggcaugugaugacuguaa

SEQ ID NO: 6163 - RNA, 21 nt, artificial
  Oligomer
ucaaugugaaagucaggguca

SEQ ID NO: 6164 - RNA, 21 nt, artificial
  Oligomer
gaguuucugcagacugguggu

SEQ ID NO: 6165 - RNA, 21 nt, artificial
  Oligomer
ccaguguucaagugcagaaau

SEQ ID NO: 6166 - RNA, 21 nt, artificial
  Oligomer
gaggagagggagaauucuguu

SEQ ID NO: 6167 - RNA, 21 nt, artificial
  Oligomer
uccagauuucauuaccuccua

SEQ ID NO: 6168 - RNA, 21 nt, artificial
  Oligomer
cccuuuuucccuuuucuccau

SEQ ID NO: 6169 - RNA, 21 nt, artificial
  Oligomer
ccgaagaauguacaaccucuu

SEQ ID NO: 6170 - RNA, 21 nt, artificial
  Oligomer
ccauuucugcagccagugucu

SEQ ID NO: 6171 - RNA, 21 nt, artificial
  Oligomer
ggaggagagggagaauucugu

SEQ ID NO: 6172 - RNA, 21 nt, artificial
  Oligomer
gcaaacucagcgagaucaaca

SEQ ID NO: 6173 - RNA, 21 nt, artificial
  Oligomer
acacccucccuuuuccucacu

SEQ ID NO: 6174 - RNA, 21 nt, artificial
  Oligomer
cagcugcuggaugagaaguuc

SEQ ID NO: 6175 - RNA, 21 nt, artificial
  Oligomer
gccacauuaaauacccgugca

SEQ ID NO: 6176 - RNA, 21 nt, artificial
  Oligomer
ugcuuaauggugugaggcguc

SEQ ID NO: 6177 - RNA, 21 nt, artificial
  Oligomer
caaacucagcgagaucaacaa

SEQ ID NO: 6178 - RNA, 21 nt, artificial
  Oligomer
ccauucacccaucaaugugaa

SEQ ID NO: 6179 - RNA, 21 nt, artificial
  Oligomer
ucugaagaggagggaguauua

SEQ ID NO: 6180 - RNA, 21 nt, artificial
  Oligomer
gcgccacuacauugccaucau

SEQ ID NO: 6181 - RNA, 21 nt, artificial
  Oligomer
ccacauuaaauacccgugcag

SEQ ID NO: 6182 - RNA, 21 nt, artificial
  Oligomer
gcagauuaucucuagagaguu

SEQ ID NO: 6183 - RNA, 21 nt, artificial
  Oligomer
gcccuuuuucccuuuucucca

SEQ ID NO: 6184 - RNA, 21 nt, artificial
  Oligomer
gcccgaauccuaguucaguuu

SEQ ID NO: 6185 - RNA, 21 nt, artificial
  Oligomer
gcuggaagagcacuuggagau

SEQ ID NO: 6186 - RNA, 21 nt, artificial
  Oligomer
ggacaguucauugcacugacu

SEQ ID NO: 6187 - RNA, 21 nt, artificial
  Oligomer
cccugacuacuuuaccagcuu

SEQ ID NO: 6188 - RNA, 21 nt, artificial
  Oligomer
uccaguguucaagugcagaaa

SEQ ID NO: 6189 - RNA, 21 nt, artificial
  Oligomer
uucccuuuucuccaugcuuaa

SEQ ID NO: 6190 - RNA, 21 nt, artificial
  Oligomer
uugacuuccuuugcccuuuuu

SEQ ID NO: 6191 - RNA, 21 nt, artificial
  Oligomer
cuggaagagcacuuggagauc

SEQ ID NO: 6192 - RNA, 21 nt, artificial
  Oligomer
ccagacccuuuugugucccau

SEQ ID NO: 6193 - RNA, 21 nt, artificial
  Oligomer
gcggaaccucaaggucuauau

SEQ ID NO: 6194 - RNA, 21 nt, artificial
  Oligomer
caccuacaauaccaucgccau

SEQ ID NO: 6195 - RNA, 21 nt, artificial
  Oligomer
gcuuuguggaagacccuacuu

SEQ ID NO: 6196 - RNA, 21 nt, artificial
  Oligomer
guguucaagugcagaaaucuu

SEQ ID NO: 6197 - RNA, 21 nt, artificial
  Oligomer
gcacuuucuguagcaaaugac

SEQ ID NO: 6198 - RNA, 21 nt, artificial
  Oligomer
ugagccuuucuagauggcuua

SEQ ID NO: 6199 - RNA, 21 nt, artificial
  Oligomer
ccaaaaaguugagccuuucua

SEQ ID NO: 6200 - RNA, 21 nt, artificial
  Oligomer
cccaaaaaguugagccuuucu

SEQ ID NO: 6201 - RNA, 21 nt, artificial
  Oligomer
cccuuuucuccaugcuuaaug

SEQ ID NO: 6202 - RNA, 21 nt, artificial
  Oligomer
guucaguuuuuugacuuccuu

SEQ ID NO: 6203 - RNA, 21 nt, artificial
  Oligomer
cccuaaaagccuguucuguug

SEQ ID NO: 6204 - RNA, 21 nt, artificial
  Oligomer
ucccuaaaagccuguucuguu

SEQ ID NO: 6205 - RNA, 21 nt, artificial
  Oligomer
cagauuucauuaccuccuacu

SEQ ID NO: 6206 - RNA, 21 nt, artificial
  Oligomer
cgggccaagcucggaauuaau

SEQ ID NO: 6207 - RNA, 21 nt, artificial
  Oligomer
gccugcacccugacuacuuua

SEQ ID NO: 6208 - RNA, 21 nt, artificial
  Oligomer
ccacaaggacuucucugucug

SEQ ID NO: 6209 - RNA, 21 nt, artificial
  Oligomer
ggccagugugccacauuaaau

SEQ ID NO: 6210 - RNA, 21 nt, artificial
  Oligomer
acgacuucucuugcccuucuu

SEQ ID NO: 6211 - RNA, 21 nt, artificial
  Oligomer
ucccuuuucuccaugcuuaau

SEQ ID NO: 6212 - RNA, 21 nt, artificial
  Oligomer
cacccaucaaugugaaaguca

SEQ ID NO: 6213 - RNA, 21 nt, artificial
  Oligomer
caaccucuucuggaggcacuu

SEQ ID NO: 6214 - RNA, 21 nt, artificial
  Oligomer
gaccacccgaagaauguacaa

SEQ ID NO: 6215 - RNA, 21 nt, artificial
  Oligomer
agacccuacuuucggauauga

SEQ ID NO: 6216 - RNA, 21 nt, artificial
  Oligomer
aguguucaagugcagaaaucu

SEQ ID NO: 6217 - RNA, 21 nt, artificial
  Oligomer
ccaggcacuuucuguagcaaa

SEQ ID NO: 6218 - RNA, 21 nt, artificial
  Oligomer
uuugacuuccuuugcccuuuu

SEQ ID NO: 6219 - RNA, 21 nt, artificial
  Oligomer
cuaguucaguuuuuugacuuc

SEQ ID NO: 6220 - RNA, 21 nt, artificial
  Oligomer
cacccgaagaauguacaaccu

SEQ ID NO: 6221 - RNA, 21 nt, artificial
  Oligomer
caaggucuauaucaagacagu

SEQ ID NO: 6222 - RNA, 21 nt, artificial
  Oligomer
ccaucuggaacuauauccacu

SEQ ID NO: 6223 - RNA, 21 nt, artificial
  Oligomer
gaagacccuacuuucggauau

SEQ ID NO: 6224 - RNA, 21 nt, artificial
  Oligomer
ggaagacccuacuuucggaua

SEQ ID NO: 6225 - RNA, 21 nt, artificial
  Oligomer
ccagacaugcugugcuuugug

SEQ ID NO: 6226 - RNA, 21 nt, artificial
  Oligomer
cccagacaugcugugcuuugu

SEQ ID NO: 6227 - RNA, 21 nt, artificial
  Oligomer
agggagugguauccaguguuc

SEQ ID NO: 6228 - RNA, 21 nt, artificial
  Oligomer
uagggagugguauccaguguu

SEQ ID NO: 6229 - RNA, 21 nt, artificial
  Oligomer
cuggccagugugccacauuaa

SEQ ID NO: 6230 - RNA, 21 nt, artificial
  Oligomer
caaggaacacauccaggccuu

SEQ ID NO: 6231 - RNA, 21 nt, artificial
  Oligomer
caggcacuuucuguagcaaau

SEQ ID NO: 6232 - RNA, 21 nt, artificial
  Oligomer
agaagcagccaaggaccgauu

SEQ ID NO: 6233 - RNA, 21 nt, artificial
  Oligomer
ccaggugaccauggcuacauu

SEQ ID NO: 6234 - RNA, 21 nt, artificial
  Oligomer
gccuuucuagauggcuuaggu

SEQ ID NO: 6235 - RNA, 21 nt, artificial
  Oligomer
cucccaaaaaguugagccuuu

SEQ ID NO: 6236 - RNA, 21 nt, artificial
  Oligomer
ugguccuuuaugcuugagguu

SEQ ID NO: 6237 - RNA, 21 nt, artificial
  Oligomer
cuggucacauugccuucugaa

SEQ ID NO: 6238 - RNA, 21 nt, artificial
  Oligomer
cccugucauuuccagauuuca

SEQ ID NO: 6239 - RNA, 21 nt, artificial
  Oligomer
ucccuuuuccucacuggaaug

SEQ ID NO: 6240 - RNA, 21 nt, artificial
  Oligomer
agagaagguccacgugaacuu

SEQ ID NO: 6241 - RNA, 21 nt, artificial
  Oligomer
cgaagaauguacaaccucuuc

SEQ ID NO: 6242 - RNA, 21 nt, artificial
  Oligomer
cggaaccucaaggucuauauc

SEQ ID NO: 6243 - RNA, 21 nt, artificial
  Oligomer
ggccaucuggaacuauaucca

SEQ ID NO: 6244 - RNA, 21 nt, artificial
  Oligomer
cagggccaucuggaacuauau

SEQ ID NO: 6245 - RNA, 21 nt, artificial
  Oligomer
ucaccuacaauaccaucgcca

SEQ ID NO: 6246 - RNA, 21 nt, artificial
  Oligomer
ggauuauaccugggaagacca

SEQ ID NO: 6247 - RNA, 21 nt, artificial
  Oligomer
uucgcugagguuuuguuucau

SEQ ID NO: 6248 - RNA, 21 nt, artificial
  Oligomer
ggcuuugcuaccaguuccaua

SEQ ID NO: 6249 - RNA, 21 nt, artificial
  Oligomer
ggagugguauccaguguucaa

SEQ ID NO: 6250 - RNA, 21 nt, artificial
  Oligomer
gagggcacugaagaaaggcaa

SEQ ID NO: 6251 - RNA, 21 nt, artificial
  Oligomer
uccaggcacuuucuguagcaa

SEQ ID NO: 6252 - RNA, 21 nt, artificial
  Oligomer
cgauuccaggcacuuucugua

SEQ ID NO: 6253 - RNA, 21 nt, artificial
  Oligomer
acauugccaaaccucugacug

SEQ ID NO: 6254 - RNA, 21 nt, artificial
  Oligomer
caaaaaguugagccuuucuag

SEQ ID NO: 6255 - RNA, 21 nt, artificial
  Oligomer
ccauggcucaucaccaaggaa

SEQ ID NO: 6256 - RNA, 21 nt, artificial
  Oligomer
ccuaguucaguuuuuugacuu

SEQ ID NO: 6257 - RNA, 21 nt, artificial
  Oligomer
cccgaauccuaguucaguuuu

SEQ ID NO: 6258 - RNA, 21 nt, artificial
  Oligomer
cauucacccaucaaugugaaa

SEQ ID NO: 6259 - RNA, 21 nt, artificial
  Oligomer
gacaguucauugcacugacuc

SEQ ID NO: 6260 - RNA, 21 nt, artificial
  Oligomer
caaggacuucucugucuggag

SEQ ID NO: 6261 - RNA, 21 nt, artificial
  Oligomer
agagaagaccacccgaagaau

SEQ ID NO: 6262 - RNA, 21 nt, artificial
  Oligomer
ucaaggucuauaucaagacag

SEQ ID NO: 6263 - RNA, 21 nt, artificial
  Oligomer
ggcaucagauaugaugacuau

SEQ ID NO: 6264 - RNA, 21 nt, artificial
  Oligomer
gcagggccaucuggaacuaua

SEQ ID NO: 6265 - RNA, 21 nt, artificial
  Oligomer
gccuauagccucaccuacaau

SEQ ID NO: 6266 - RNA, 21 nt, artificial
  Oligomer
gcccaggauuauaccugggaa

SEQ ID NO: 6267 - RNA, 21 nt, artificial
  Oligomer
ucuuuggcuuugcuaccaguu

SEQ ID NO: 6268 - RNA, 21 nt, artificial
  Oligomer
ggcacuuucuguagcaaauga

SEQ ID NO: 6269 - RNA, 21 nt, artificial
  Oligomer
gcacccugacuacuuuaccag

SEQ ID NO: 6270 - RNA, 21 nt, artificial
  Oligomer
cugccaacagcaagcggauuu

SEQ ID NO: 6271 - RNA, 21 nt, artificial
  Oligomer
ucccaaaaaguugagccuuuc

SEQ ID NO: 6272 - RNA, 21 nt, artificial
  Oligomer
gcuggucacauugccuucuga

SEQ ID NO: 6273 - RNA, 21 nt, artificial
  Oligomer
cucuagagaguuugagccuuu

SEQ ID NO: 6274 - RNA, 21 nt, artificial
  Oligomer
aguucaguuuuuugacuuccu

SEQ ID NO: 6275 - RNA, 21 nt, artificial
  Oligomer
gcuguugcccgaauccuaguu

SEQ ID NO: 6276 - RNA, 21 nt, artificial
  Oligomer
ccaguucccuaaaagccuguu

SEQ ID NO: 6277 - RNA, 21 nt, artificial
  Oligomer
agcuggucuguguguccaguu

SEQ ID NO: 6278 - RNA, 21 nt, artificial
  Oligomer
gccauucacccaucaauguga

SEQ ID NO: 6279 - RNA, 21 nt, artificial
  Oligomer
cugucauuuccagauuucauu

SEQ ID NO: 6280 - RNA, 21 nt, artificial
  Oligomer
ccugucauuuccagauuucau

SEQ ID NO: 6281 - RNA, 21 nt, artificial
  Oligomer
uggacaguucauugcacugac

SEQ ID NO: 6282 - RNA, 21 nt, artificial
  Oligomer
ccuuuuccucacuggaaugga

SEQ ID NO: 6283 - RNA, 21 nt, artificial
  Oligomer
ccaucaguguucuuaccuggu

SEQ ID NO: 6284 - RNA, 21 nt, artificial
  Oligomer
agaccacccgaagaauguaca

SEQ ID NO: 6285 - RNA, 21 nt, artificial
  Oligomer
ggaaccucaaggucuauauca

SEQ ID NO: 6286 - RNA, 21 nt, artificial
  Oligomer
ugcgucuuuggcaucagauau

SEQ ID NO: 6287 - RNA, 21 nt, artificial
  Oligomer
cgccacuacauugccaucaug

SEQ ID NO: 6288 - RNA, 21 nt, artificial
  Oligomer
cuacaauaccaucgccaugca

SEQ ID NO: 6289 - RNA, 21 nt, artificial
  Oligomer
ccaggauuauaccugggaaga

SEQ ID NO: 6290 - RNA, 21 nt, artificial
  Oligomer
acacccagacaugcugugcuu

SEQ ID NO: 6291 - RNA, 21 nt, artificial
  Oligomer
uggcuuugcuaccaguuccau

SEQ ID NO: 6292 - RNA, 21 nt, artificial
  Oligomer
agugcagaaaucuuuggcuuu

SEQ ID NO: 6293 - RNA, 21 nt, artificial
  Oligomer
gggagugguauccaguguuca

SEQ ID NO: 6294 - RNA, 21 nt, artificial
  Oligomer
accaguuuggagggcacugaa

SEQ ID NO: 6295 - RNA, 21 nt, artificial
  Oligomer
gacugugaauuacgacuucuc

SEQ ID NO: 6296 - RNA, 21 nt, artificial
  Oligomer
aggcacuuucuguagcaaaug

SEQ ID NO: 6297 - RNA, 21 nt, artificial
  Oligomer
agauuaucucuagagaguuug

SEQ ID NO: 6298 - RNA, 21 nt, artificial
  Oligomer
cagauuaucucuagagaguuu

SEQ ID NO: 6299 - RNA, 21 nt, artificial
  Oligomer
ccgaauccuaguucaguuuuu

SEQ ID NO: 6300 - RNA, 21 nt, artificial
  Oligomer
guguguccaguucccuaaaag

SEQ ID NO: 6301 - RNA, 21 nt, artificial
  Oligomer
ucacccaucaaugugaaaguc

SEQ ID NO: 6302 - RNA, 21 nt, artificial
  Oligomer
guacaaccucuucuggaggca

SEQ ID NO: 6303 - RNA, 21 nt, artificial
  Oligomer
ccucaaggucuauaucaagac

SEQ ID NO: 6304 - RNA, 21 nt, artificial
  Oligomer
gagcggaaccucaaggucuau

SEQ ID NO: 6305 - RNA, 21 nt, artificial
  Oligomer
cgucuuuggcaucagauauga

SEQ ID NO: 6306 - RNA, 21 nt, artificial
  Oligomer
gcgucuuuggcaucagauaug

SEQ ID NO: 6307 - RNA, 21 nt, artificial
  Oligomer
acugcgucuuuggcaucagau

SEQ ID NO: 6308 - RNA, 21 nt, artificial
  Oligomer
gccaucuggaacuauauccac

SEQ ID NO: 6309 - RNA, 21 nt, artificial
  Oligomer
uggaagacccuacuuucggau

SEQ ID NO: 6310 - RNA, 21 nt, artificial
  Oligomer
cacccagacaugcugugcuuu

SEQ ID NO: 6311 - RNA, 21 nt, artificial
  Oligomer
ugagcuggagaagucagagag

SEQ ID NO: 6312 - RNA, 21 nt, artificial
  Oligomer
ugcuaccaguuccauaugaug

SEQ ID NO: 6313 - RNA, 21 nt, artificial
  Oligomer
uggccagugugccacauuaaa

SEQ ID NO: 6314 - RNA, 21 nt, artificial
  Oligomer
cgacuucucuugcccuucuuc

SEQ ID NO: 6315 - RNA, 21 nt, artificial
  Oligomer
cacuuucuguagcaaaugacu

SEQ ID NO: 6316 - RNA, 21 nt, artificial
  Oligomer
gcaagcggauuuucuugcaag

SEQ ID NO: 6317 - RNA, 21 nt, artificial
  Oligomer
ugccaacagcaagcggauuuu

SEQ ID NO: 6318 - RNA, 21 nt, artificial
  Oligomer
caggugaccauggcuacauug

SEQ ID NO: 6319 - RNA, 21 nt, artificial
  Oligomer
ugcuggucacauugccuucug

SEQ ID NO: 6320 - RNA, 21 nt, artificial
  Oligomer
ugcccgaauccuaguucaguu

SEQ ID NO: 6321 - RNA, 21 nt, artificial
  Oligomer
cccaucaaugugaaagucagg

SEQ ID NO: 6322 - RNA, 21 nt, artificial
  Oligomer
acaaguguuguggccuuccug

SEQ ID NO: 6323 - RNA, 21 nt, artificial
  Oligomer
gaauggacaguucauugcacu

SEQ ID NO: 6324 - RNA, 21 nt, artificial
  Oligomer
cccgaagaauguacaaccucu

SEQ ID NO: 6325 - RNA, 21 nt, artificial
  Oligomer
acccgaagaauguacaaccuc

SEQ ID NO: 6326 - RNA, 21 nt, artificial
  Oligomer
ccacccgaagaauguacaacc

SEQ ID NO: 6327 - RNA, 21 nt, artificial
  Oligomer
gaagaccacccgaagaaugua

SEQ ID NO: 6328 - RNA, 21 nt, artificial
  Oligomer
gcaucagauaugaugacuaug

SEQ ID NO: 6329 - RNA, 21 nt, artificial
  Oligomer
cacugcgucuuuggcaucaga

SEQ ID NO: 6330 - RNA, 21 nt, artificial
  Oligomer
cuggaacuauauccacugcgu

SEQ ID NO: 6331 - RNA, 21 nt, artificial
  Oligomer
agaccauggcuacucgcugau

SEQ ID NO: 6332 - RNA, 21 nt, artificial
  Oligomer
cccaggauuauaccugggaag

SEQ ID NO: 6333 - RNA, 21 nt, artificial
  Oligomer
ggauaugaggacuucacucgg

SEQ ID NO: 6334 - RNA, 21 nt, artificial
  Oligomer
cuacuuucggauaugaggacu

SEQ ID NO: 6335 - RNA, 21 nt, artificial
  Oligomer
cgcuuugagcuggagaaguca

SEQ ID NO: 6336 - RNA, 21 nt, artificial
  Oligomer
uccuccuucguguuuggcugu

SEQ ID NO: 6337 - RNA, 21 nt, artificial
  Oligomer
gcccuucuucuagcagucugu

SEQ ID NO: 6338 - RNA, 21 nt, artificial
  Oligomer
caagcggauuuucuugcaaga

SEQ ID NO: 6339 - RNA, 21 nt, artificial
  Oligomer
agcaagcggauuuucuugcaa

SEQ ID NO: 6340 - RNA, 21 nt, artificial
  Oligomer
gccaacagcaagcggauuuuc

SEQ ID NO: 6341 - RNA, 21 nt, artificial
  Oligomer
cuacauugccaaaccucugac

SEQ ID NO: 6342 - RNA, 21 nt, artificial
  Oligomer
ggcuacauugccaaaccucug

SEQ ID NO: 6343 - RNA, 21 nt, artificial
  Oligomer
ugaccauggcuacauugccaa

SEQ ID NO: 6344 - RNA, 21 nt, artificial
  Oligomer
cgagaucaacaaguugcuggc

SEQ ID NO: 6345 - RNA, 21 nt, artificial
  Oligomer
gcgcaaacucagcgagaucaa

SEQ ID NO: 6346 - RNA, 21 nt, artificial
  Oligomer
cucccuuuuccucacuggaau

SEQ ID NO: 6347 - RNA, 21 nt, artificial
  Oligomer
gaaccucaaggucuauaucaa

SEQ ID NO: 6348 - RNA, 21 nt, artificial
  Oligomer
agacaaccuggcaguggugau

SEQ ID NO: 6349 - RNA, 21 nt, artificial
  Oligomer
ggaacuauauccacugcgucu

SEQ ID NO: 6350 - RNA, 21 nt, artificial
  Oligomer
uacuuucggauaugaggacuu

SEQ ID NO: 6351 - RNA, 21 nt, artificial
  Oligomer
gacccuacuuucggauaugag

SEQ ID NO: 6352 - RNA, 21 nt, artificial
  Oligomer
ugccuccucucugaccaguuu

SEQ ID NO: 6353 - RNA, 21 nt, artificial
  Oligomer
cugugaauuacgacuucucuu

SEQ ID NO: 6354 - RNA, 21 nt, artificial
  Oligomer
ugacugugaauuacgacuucu

SEQ ID NO: 6355 - RNA, 21 nt, artificial
  Oligomer
agcaaaugacugugaauuacg

SEQ ID NO: 6356 - RNA, 21 nt, artificial
  Oligomer
ccaucccaguaucucaucugu

SEQ ID NO: 6357 - RNA, 21 nt, artificial
  Oligomer
cccaucccaguaucucaucug

SEQ ID NO: 6358 - RNA, 21 nt, artificial
  Oligomer
ggcucaucaccaaggaacaca

SEQ ID NO: 6359 - RNA, 21 nt, artificial
  Oligomer
uccuuuaugcuugagguucca

SEQ ID NO: 6360 - RNA, 21 nt, artificial
  Oligomer
gagccuuugcuggucacauug

SEQ ID NO: 6361 - RNA, 21 nt, artificial
  Oligomer
ugagccuuugcuggucacauu

SEQ ID NO: 6362 - RNA, 21 nt, artificial
  Oligomer
agagaguuugagccuuugcug

SEQ ID NO: 6363 - RNA, 21 nt, artificial
  Oligomer
acucagcgagaucaacaaguu

SEQ ID NO: 6364 - RNA, 21 nt, artificial
  Oligomer
cuguguguccaguucccuaaa

SEQ ID NO: 6365 - RNA, 21 nt, artificial
  Oligomer
ggaauggacaguucauugcac

SEQ ID NO: 6366 - RNA, 21 nt, artificial
  Oligomer
uggaauggacaguucauugca

SEQ ID NO: 6367 - RNA, 21 nt, artificial
  Oligomer
ucagagaagguccacgugaac

SEQ ID NO: 6368 - RNA, 21 nt, artificial
  Oligomer
cuauaucaagacaguggccug

SEQ ID NO: 6369 - RNA, 21 nt, artificial
  Oligomer
cucaaggucuauaucaagaca

SEQ ID NO: 6370 - RNA, 21 nt, artificial
  Oligomer
gucuuuggcaucagauaugau

SEQ ID NO: 6371 - RNA, 21 nt, artificial
  Oligomer
uggaacuauauccacugcguc

SEQ ID NO: 6372 - RNA, 21 nt, artificial
  Oligomer
ugcuuuguggaagacccuacu

SEQ ID NO: 6373 - RNA, 21 nt, artificial
  Oligomer
agggacccguugaacaacucu

SEQ ID NO: 6374 - RNA, 21 nt, artificial
  Oligomer
acuguaaauguucacugggug

SEQ ID NO: 6375 - RNA, 21 nt, artificial
  Oligomer
gugaugacuguaaauguucac

SEQ ID NO: 6376 - RNA, 21 nt, artificial
  Oligomer
ugcaagaaggugugcaggaga

SEQ ID NO: 6377 - RNA, 21 nt, artificial
  Oligomer
cuccucucugaccaguuugga

SEQ ID NO: 6378 - RNA, 21 nt, artificial
  Oligomer
gaccgauuccaggcacuuucu

SEQ ID NO: 6379 - RNA, 21 nt, artificial
  Oligomer
gggagaauucuguucucccag

SEQ ID NO: 6380 - RNA, 21 nt, artificial
  Oligomer
cccacaaggacuucucugucu

SEQ ID NO: 6381 - RNA, 21 nt, artificial
  Oligomer
uggcaucagauaugaugacua

SEQ ID NO: 6382 - RNA, 21 nt, artificial
  Oligomer
cuauauccacugcgucuuugg

SEQ ID NO: 6383 - RNA, 21 nt, artificial
  Oligomer
gccacuacauugccaucaugg

SEQ ID NO: 6384 - RNA, 21 nt, artificial
  Oligomer
agccuauagccucaccuacaa

SEQ ID NO: 6385 - RNA, 21 nt, artificial
  Oligomer
agaaguuccaggcagccuaua

SEQ ID NO: 6386 - RNA, 21 nt, artificial
  Oligomer
gagaaguuccaggcagccuau

SEQ ID NO: 6387 - RNA, 21 nt, artificial
  Oligomer
cccuacuuucggauaugagga

SEQ ID NO: 6388 - RNA, 21 nt, artificial
  Oligomer
ccugacuacuuuaccagcuuc

SEQ ID NO: 6389 - RNA, 21 nt, artificial
  Oligomer
cagcaagcggauuuucuugca

SEQ ID NO: 6390 - RNA, 21 nt, artificial
  Oligomer
ccauggcuacauugccaaacc

SEQ ID NO: 6391 - RNA, 21 nt, artificial
  Oligomer
gagccuuucuagauggcuuag

SEQ ID NO: 6392 - RNA, 21 nt, artificial
  Oligomer
gagaauucuguucucccagag

SEQ ID NO: 6393 - RNA, 21 nt, artificial
  Oligomer
ggagaauucuguucucccaga

SEQ ID NO: 6394 - RNA, 21 nt, artificial
  Oligomer
ccuuugcuggucacauugccu

SEQ ID NO: 6395 - RNA, 21 nt, artificial
  Oligomer
cuagagaguuugagccuuugc

SEQ ID NO: 6396 - RNA, 21 nt, artificial
  Oligomer
ucacuggaauggacaguucau

SEQ ID NO: 6397 - RNA, 21 nt, artificial
  Oligomer
ugcagugggcuugugugugau

SEQ ID NO: 6398 - RNA, 21 nt, artificial
  Oligomer
ggacuucucugucuggagaca

SEQ ID NO: 6399 - RNA, 21 nt, artificial
  Oligomer
aggacuucucugucuggagac

SEQ ID NO: 6400 - RNA, 21 nt, artificial
  Oligomer
cugcgucuuuggcaucagaua

SEQ ID NO: 6401 - RNA, 21 nt, artificial
  Oligomer
ugacuacuuuaccagcuucug

SEQ ID NO: 6402 - RNA, 21 nt, artificial
  Oligomer
cugacuacuuuaccagcuucu

SEQ ID NO: 6403 - RNA, 21 nt, artificial
  Oligomer
acacauccaggccuugcugaa

SEQ ID NO: 6404 - RNA, 21 nt, artificial
  Oligomer
ccgauuccaggcacuuucugu

SEQ ID NO: 6405 - RNA, 21 nt, artificial
  Oligomer
cagcgagaucaacaaguugcu

SEQ ID NO: 6406 - RNA, 21 nt, artificial
  Oligomer
caguucccuaaaagccuguuc

SEQ ID NO: 6407 - RNA, 21 nt, artificial
  Oligomer
gaagagcacuuggagauccua

SEQ ID NO: 6408 - RNA, 21 nt, artificial
  Oligomer
cuauagccucaccuacaauac

SEQ ID NO: 6409 - RNA, 21 nt, artificial
  Oligomer
ugcagaaaucuuuggcuuugc

SEQ ID NO: 6410 - RNA, 21 nt, artificial
  Oligomer
caagugcagaaaucuuuggcu

SEQ ID NO: 6411 - RNA, 21 nt, artificial
  Oligomer
ugaugacuguaaauguucacu

SEQ ID NO: 6412 - RNA, 21 nt, artificial
  Oligomer
gaccauggcuacauugccaaa

SEQ ID NO: 6413 - RNA, 21 nt, artificial
  Oligomer
aggguucuuguuuggacccug

SEQ ID NO: 6414 - RNA, 21 nt, artificial
  Oligomer
gaggcaccaggguucuuguuu

SEQ ID NO: 6415 - RNA, 21 nt, artificial
  Oligomer
ugcuugagguuccaaccugga

SEQ ID NO: 6416 - RNA, 21 nt, artificial
  Oligomer
ugacuuccuuugcccuuuuuc

SEQ ID NO: 6417 - RNA, 21 nt, artificial
  Oligomer
uccaguucccuaaaagccugu

SEQ ID NO: 6418 - RNA, 21 nt, artificial
  Oligomer
gcacuuggagauccuaaggga

SEQ ID NO: 6419 - RNA, 21 nt, artificial
  Oligomer
cucacuggaauggacaguuca

SEQ ID NO: 6420 - RNA, 21 nt, artificial
  Oligomer
ccucacuggaauggacaguuc

SEQ ID NO: 6421 - RNA, 21 nt, artificial
  Oligomer
cagacccuuuugugucccaug

SEQ ID NO: 6422 - RNA, 21 nt, artificial
  Oligomer
gacuucucugucuggagacag

SEQ ID NO: 6423 - RNA, 21 nt, artificial
  Oligomer
gccaucaguguucuuaccugg

SEQ ID NO: 6424 - RNA, 21 nt, artificial
  Oligomer
cgccaucaguguucuuaccug

SEQ ID NO: 6425 - RNA, 21 nt, artificial
  Oligomer
uagccucaccuacaauaccau

SEQ ID NO: 6426 - RNA, 21 nt, artificial
  Oligomer
ccuauagccucaccuacaaua

SEQ ID NO: 6427 - RNA, 21 nt, artificial
  Oligomer
ggcuuaaguggguugcuucca

SEQ ID NO: 6428 - RNA, 21 nt, artificial
  Oligomer
cacauugccuucugaagagga

SEQ ID NO: 6429 - RNA, 21 nt, artificial
  Oligomer
ccuuuucuccaugcuuaaugg

SEQ ID NO: 6430 - RNA, 21 nt, artificial
  Oligomer
ugccacaaguguuguggccuu

SEQ ID NO: 6431 - RNA, 21 nt, artificial
  Oligomer
ggaagagcacuuggagauccu

SEQ ID NO: 6432 - RNA, 21 nt, artificial
  Oligomer
cagagaagaccacccgaagaa

SEQ ID NO: 6433 - RNA, 21 nt, artificial
  Oligomer
ugagaaguuccaggcagccua

SEQ ID NO: 6434 - RNA, 21 nt, artificial
  Oligomer
cugugcuuuguggaagacccu

SEQ ID NO: 6435 - RNA, 21 nt, artificial
  Oligomer
ccaugcuuaauggugugaggc

SEQ ID NO: 6436 - RNA, 21 nt, artificial
  Oligomer
cuggaugagaaguuccaggca

SEQ ID NO: 6437 - RNA, 21 nt, artificial
  Oligomer
gagagggagaauucuguucuc

SEQ ID NO: 6438 - RNA, 21 nt, artificial
  Oligomer
cgcaaacucagcgagaucaac

SEQ ID NO: 6439 - RNA, 21 nt, artificial
  Oligomer
cacuggaauggacaguucauu

SEQ ID NO: 6440 - RNA, 21 nt, artificial
  Oligomer
uccucacuggaauggacaguu

SEQ ID NO: 6441 - RNA, 21 nt, artificial
  Oligomer
ccucccuuuuccucacuggaa

SEQ ID NO: 6442 - RNA, 21 nt, artificial
  Oligomer
ccuucugaagaggagggagua

SEQ ID NO: 6443 - RNA, 21 nt, artificial
  Oligomer
uuauaaucuaauacucccucc

SEQ ID NO: 6444 - RNA, 21 nt, artificial
  Oligomer
aaguaggagguaaugaaaucu

SEQ ID NO: 6445 - RNA, 21 nt, artificial
  Oligomer
cacuuguggcacauuaauucc

SEQ ID NO: 6446 - RNA, 21 nt, artificial
  Oligomer
uuucucaucauauggaacugg

SEQ ID NO: 6447 - RNA, 21 nt, artificial
  Oligomer
guauuuaauguggcacacugg

SEQ ID NO: 6448 - RNA, 21 nt, artificial
  Oligomer
auuuacagucaucacaugccc

SEQ ID NO: 6449 - RNA, 21 nt, artificial
  Oligomer
uauuuaauguggcacacuggc

SEQ ID NO: 6450 - RNA, 21 nt, artificial
  Oligomer
uuuuugggagacaucugcggc

SEQ ID NO: 6451 - RNA, 21 nt, artificial
  Oligomer
uaaaggaccaaaauaaagagg

SEQ ID NO: 6452 - RNA, 21 nt, artificial
  Oligomer
aaaaaacugaacuaggauucg

SEQ ID NO: 6453 - RNA, 21 nt, artificial
  Oligomer
cucaggagucaggucauguag

SEQ ID NO: 6454 - RNA, 21 nt, artificial
  Oligomer
auaaucuaauacucccuccuc

SEQ ID NO: 6455 - RNA, 21 nt, artificial
  Oligomer
aaaagggaaaaagggcaaagg

SEQ ID NO: 6456 - RNA, 21 nt, artificial
  Oligomer
ugaugggugaauggcaaguag

SEQ ID NO: 6457 - RNA, 21 nt, artificial
  Oligomer
agcaaagccaaagauuucugc

SEQ ID NO: 6458 - RNA, 21 nt, artificial
  Oligomer
uaauucacagucauuugcuac

SEQ ID NO: 6459 - RNA, 21 nt, artificial
  Oligomer
aaagggaaaaagggcaaagga

SEQ ID NO: 6460 - RNA, 21 nt, artificial
  Oligomer
acuuguggcacauuaauuccg

SEQ ID NO: 6461 - RNA, 21 nt, artificial
  Oligomer
cguuuauuucucaucauaugg

SEQ ID NO: 6462 - RNA, 21 nt, artificial
  Oligomer
auuucucaucauauggaacug

SEQ ID NO: 6463 - RNA, 21 nt, artificial
  Oligomer
acauuuacagucaucacaugc

SEQ ID NO: 6464 - RNA, 21 nt, artificial
  Oligomer
auucacagucauuugcuacag

SEQ ID NO: 6465 - RNA, 21 nt, artificial
  Oligomer
ugaucuugcaagaaaauccgc

SEQ ID NO: 6466 - RNA, 21 nt, artificial
  Oligomer
auguguuccuuggugaugagc

SEQ ID NO: 6467 - RNA, 21 nt, artificial
  Oligomer
uauaaucuaauacucccuccu

SEQ ID NO: 6468 - RNA, 21 nt, artificial
  Oligomer
uugaugggugaauggcaagua

SEQ ID NO: 6469 - RNA, 21 nt, artificial
  Oligomer
gaugggugaauggcaaguagg

SEQ ID NO: 6470 - RNA, 21 nt, artificial
  Oligomer
aauggcaaguaggagguaaug

SEQ ID NO: 6471 - RNA, 21 nt, artificial
  Oligomer
auggcaaguaggagguaauga

SEQ ID NO: 6472 - RNA, 21 nt, artificial
  Oligomer
gguaaugaaaucuggaaauga

SEQ ID NO: 6473 - RNA, 21 nt, artificial
  Oligomer
cuuguggcacauuaauuccga

SEQ ID NO: 6474 - RNA, 21 nt, artificial
  Oligomer
uuguggcacauuaauuccgag

SEQ ID NO: 6475 - RNA, 21 nt, artificial
  Oligomer
aucauauggaacugguagcaa

SEQ ID NO: 6476 - RNA, 21 nt, artificial
  Oligomer
auauggaacugguagcaaagc

SEQ ID NO: 6477 - RNA, 21 nt, artificial
  Oligomer
uagcaaagccaaagauuucug

SEQ ID NO: 6478 - RNA, 21 nt, artificial
  Oligomer
acuuuuugggagacaucugcg

SEQ ID NO: 6479 - RNA, 21 nt, artificial
  Oligomer
aaaggaccaaaauaaagagga

SEQ ID NO: 6480 - RNA, 21 nt, artificial
  Oligomer
ugcucaggagucaggucaugu

SEQ ID NO: 6481 - RNA, 21 nt, artificial
  Oligomer
uucucaucauauggaacuggu

SEQ ID NO: 6482 - RNA, 21 nt, artificial
  Oligomer
uuuacagucaucacaugcccu

SEQ ID NO: 6483 - RNA, 21 nt, artificial
  Oligomer
aucacaugcccucuagaaccc

SEQ ID NO: 6484 - RNA, 21 nt, artificial
  Oligomer
ucguaauucacagucauuugc

SEQ ID NO: 6485 - RNA, 21 nt, artificial
  Oligomer
cugaucuugcaagaaaauccg

SEQ ID NO: 6486 - RNA, 21 nt, artificial
  Oligomer
aacuuuuugggagacaucugc

SEQ ID NO: 6487 - RNA, 21 nt, artificial
  Oligomer
uuggaaccucaagcauaaagg

SEQ ID NO: 6488 - RNA, 21 nt, artificial
  Oligomer
gucguaauucacagucauuug

SEQ ID NO: 6489 - RNA, 21 nt, artificial
  Oligomer
uucacagucauuugcuacaga

SEQ ID NO: 6490 - RNA, 21 nt, artificial
  Oligomer
caccuaagccaucuagaaagg

SEQ ID NO: 6491 - RNA, 21 nt, artificial
  Oligomer
uaaucuaauacucccuccucu

SEQ ID NO: 6492 - RNA, 21 nt, artificial
  Oligomer
aucuaauacucccuccucuuc

SEQ ID NO: 6493 - RNA, 21 nt, artificial
  Oligomer
acauuaauuccgagcuuggcc

SEQ ID NO: 6494 - RNA, 21 nt, artificial
  Oligomer
aaagacgcaguggauauaguu

SEQ ID NO: 6495 - RNA, 21 nt, artificial
  Oligomer
aagacgcaguggauauaguuc

SEQ ID NO: 6496 - RNA, 21 nt, artificial
  Oligomer
uccacaaagcacagcaugucu

SEQ ID NO: 6497 - RNA, 21 nt, artificial
  Oligomer
ucacaugcccucuagaaccca

SEQ ID NO: 6498 - RNA, 21 nt, artificial
  Oligomer
ucucuccugcacaccuucuug

SEQ ID NO: 6499 - RNA, 21 nt, artificial
  Oligomer
aaacacgaaggaggagagcga

SEQ ID NO: 6500 - RNA, 21 nt, artificial
  Oligomer
cauggagaaaagggaaaaagg

SEQ ID NO: 6501 - RNA, 21 nt, artificial
  Oligomer
agguaagaacacugauggcgg

SEQ ID NO: 6502 - RNA, 21 nt, artificial
  Oligomer
accucagcgaacguuuauuuc

SEQ ID NO: 6503 - RNA, 21 nt, artificial
  Oligomer
uacagucaucacaugcccucu

SEQ ID NO: 6504 - RNA, 21 nt, artificial
  Oligomer
ucuucucuccugcacaccuuc

SEQ ID NO: 6505 - RNA, 21 nt, artificial
  Oligomer
gauguguuccuuggugaugag

SEQ ID NO: 6506 - RNA, 21 nt, artificial
  Oligomer
uccaaacaagaacccuggugc

SEQ ID NO: 6507 - RNA, 21 nt, artificial
  Oligomer
cuuuuugggagacaucugcgg

SEQ ID NO: 6508 - RNA, 21 nt, artificial
  Oligomer
aaggaccaaaauaaagaggau

SEQ ID NO: 6509 - RNA, 21 nt, artificial
  Oligomer
uguggcacauuaauuccgagc

SEQ ID NO: 6510 - RNA, 21 nt, artificial
  Oligomer
gcacauuaauuccgagcuugg

SEQ ID NO: 6511 - RNA, 21 nt, artificial
  Oligomer
cacauuaauuccgagcuuggc

SEQ ID NO: 6512 - RNA, 21 nt, artificial
  Oligomer
cauuaauuccgagcuuggccc

SEQ ID NO: 6513 - RNA, 21 nt, artificial
  Oligomer
acugcacaucacacacaagcc

SEQ ID NO: 6514 - RNA, 21 nt, artificial
  Oligomer
ucagcgaacguuuauuucuca

SEQ ID NO: 6515 - RNA, 21 nt, artificial
  Oligomer
aucuugcaagaaaauccgcuu

SEQ ID NO: 6516 - RNA, 21 nt, artificial
  Oligomer
aagaaaauccgcuugcuguug

SEQ ID NO: 6517 - RNA, 21 nt, artificial
  Oligomer
agaaaauccgcuugcuguugg

SEQ ID NO: 6518 - RNA, 21 nt, artificial
  Oligomer
caaaggaagucaaaaaacuga

SEQ ID NO: 6519 - RNA, 21 nt, artificial
  Oligomer
caaaaaacugaacuaggauuc

SEQ ID NO: 6520 - RNA, 21 nt, artificial
  Oligomer
aacuucucauccagcagcugc

SEQ ID NO: 6521 - RNA, 21 nt, artificial
  Oligomer
aaacaaaaccucagcgaacgu

SEQ ID NO: 6522 - RNA, 21 nt, artificial
  Oligomer
aaccucagcgaacguuuauuu

SEQ ID NO: 6523 - RNA, 21 nt, artificial
  Oligomer
cauuuacagucaucacaugcc

SEQ ID NO: 6524 - RNA, 21 nt, artificial
  Oligomer
cagucaucacaugcccucuag

SEQ ID NO: 6525 - RNA, 21 nt, artificial
  Oligomer
uuuugggagacaucugcggca

SEQ ID NO: 6526 - RNA, 21 nt, artificial
  Oligomer
gcaaaggaagucaaaaaacug

SEQ ID NO: 6527 - RNA, 21 nt, artificial
  Oligomer
ugcacaucacacacaagccca

SEQ ID NO: 6528 - RNA, 21 nt, artificial
  Oligomer
acccacccagugaacauuuac

SEQ ID NO: 6529 - RNA, 21 nt, artificial
  Oligomer
cacagacugcuagaagaaggg

SEQ ID NO: 6530 - RNA, 21 nt, artificial
  Oligomer
agaacagaauucucccucucc

SEQ ID NO: 6531 - RNA, 21 nt, artificial
  Oligomer
caacuuguugaucucgcugag

SEQ ID NO: 6532 - RNA, 21 nt, artificial
  Oligomer
guaggagguaaugaaaucugg

SEQ ID NO: 6533 - RNA, 21 nt, artificial
  Oligomer
uucacguggaccuucucugag

SEQ ID NO: 6534 - RNA, 21 nt, artificial
  Oligomer
cugcacuugaacacuggauac

SEQ ID NO: 6535 - RNA, 21 nt, artificial
  Oligomer
uuacagucaucacaugcccuc

SEQ ID NO: 6536 - RNA, 21 nt, artificial
  Oligomer
ugacccugacuuucacauuga

SEQ ID NO: 6537 - RNA, 21 nt, artificial
  Oligomer
accaccagucugcagaaacuc

SEQ ID NO: 6538 - RNA, 21 nt, artificial
  Oligomer
auuucugcacuugaacacugg

SEQ ID NO: 6539 - RNA, 21 nt, artificial
  Oligomer
aacagaauucucccucuccuc

SEQ ID NO: 6540 - RNA, 21 nt, artificial
  Oligomer
uaggagguaaugaaaucugga

SEQ ID NO: 6541 - RNA, 21 nt, artificial
  Oligomer
auggagaaaagggaaaaaggg

SEQ ID NO: 6542 - RNA, 21 nt, artificial
  Oligomer
aagagguuguacauucuucgg

SEQ ID NO: 6543 - RNA, 21 nt, artificial
  Oligomer
agacacuggcugcagaaaugg

SEQ ID NO: 6544 - RNA, 21 nt, artificial
  Oligomer
acagaauucucccucuccucc

SEQ ID NO: 6545 - RNA, 21 nt, artificial
  Oligomer
uguugaucucgcugaguuugc

SEQ ID NO: 6546 - RNA, 21 nt, artificial
  Oligomer
agugaggaaaagggagggugu

SEQ ID NO: 6547 - RNA, 21 nt, artificial
  Oligomer
gaacuucucauccagcagcug

SEQ ID NO: 6548 - RNA, 21 nt, artificial
  Oligomer
ugcacggguauuuaauguggc

SEQ ID NO: 6549 - RNA, 21 nt, artificial
  Oligomer
gacgccucacaccauuaagca

SEQ ID NO: 6550 - RNA, 21 nt, artificial
  Oligomer
uuguugaucucgcugaguuug

SEQ ID NO: 6551 - RNA, 21 nt, artificial
  Oligomer
uucacauugaugggugaaugg

SEQ ID NO: 6552 - RNA, 21 nt, artificial
  Oligomer
uaauacucccuccucuucaga

SEQ ID NO: 6553 - RNA, 21 nt, artificial
  Oligomer
augauggcaauguaguggcgc

SEQ ID NO: 6554 - RNA, 21 nt, artificial
  Oligomer
cugcacggguauuuaaugugg

SEQ ID NO: 6555 - RNA, 21 nt, artificial
  Oligomer
aacucucuagagauaaucugc

SEQ ID NO: 6556 - RNA, 21 nt, artificial
  Oligomer
uggagaaaagggaaaaagggc

SEQ ID NO: 6557 - RNA, 21 nt, artificial
  Oligomer
aaacugaacuaggauucgggc

SEQ ID NO: 6558 - RNA, 21 nt, artificial
  Oligomer
aucuccaagugcucuuccagc

SEQ ID NO: 6559 - RNA, 21 nt, artificial
  Oligomer
agucagugcaaugaacugucc

SEQ ID NO: 6560 - RNA, 21 nt, artificial
  Oligomer
aagcugguaaaguagucaggg

SEQ ID NO: 6561 - RNA, 21 nt, artificial
  Oligomer
uuucugcacuugaacacugga

SEQ ID NO: 6562 - RNA, 21 nt, artificial
  Oligomer
uuaagcauggagaaaagggaa

SEQ ID NO: 6563 - RNA, 21 nt, artificial
  Oligomer
aaaaagggcaaaggaagucaa

SEQ ID NO: 6564 - RNA, 21 nt, artificial
  Oligomer
gaucuccaagugcucuuccag

SEQ ID NO: 6565 - RNA, 21 nt, artificial
  Oligomer
augggacacaaaagggucugg

SEQ ID NO: 6566 - RNA, 21 nt, artificial
  Oligomer
auauagaccuugagguuccgc

SEQ ID NO: 6567 - RNA, 21 nt, artificial
  Oligomer
auggcgaugguauuguaggug

SEQ ID NO: 6568 - RNA, 21 nt, artificial
  Oligomer
aaguagggucuuccacaaagc

SEQ ID NO: 6569 - RNA, 21 nt, artificial
  Oligomer
aagauuucugcacuugaacac

SEQ ID NO: 6570 - RNA, 21 nt, artificial
  Oligomer
gucauuugcuacagaaagugc

SEQ ID NO: 6571 - RNA, 21 nt, artificial
  Oligomer
uaagccaucuagaaaggcuca

SEQ ID NO: 6572 - RNA, 21 nt, artificial
  Oligomer
uagaaaggcucaacuuuuugg

SEQ ID NO: 6573 - RNA, 21 nt, artificial
  Oligomer
agaaaggcucaacuuuuuggg

SEQ ID NO: 6574 - RNA, 21 nt, artificial
  Oligomer
cauuaagcauggagaaaaggg

SEQ ID NO: 6575 - RNA, 21 nt, artificial
  Oligomer
aaggaagucaaaaaacugaac

SEQ ID NO: 6576 - RNA, 21 nt, artificial
  Oligomer
caacagaacaggcuuuuaggg

SEQ ID NO: 6577 - RNA, 21 nt, artificial
  Oligomer
aacagaacaggcuuuuaggga

SEQ ID NO: 6578 - RNA, 21 nt, artificial
  Oligomer
aguaggagguaaugaaaucug

SEQ ID NO: 6579 - RNA, 21 nt, artificial
  Oligomer
auuaauuccgagcuuggcccg

SEQ ID NO: 6580 - RNA, 21 nt, artificial
  Oligomer
uaaaguagucagggugcaggc

SEQ ID NO: 6581 - RNA, 21 nt, artificial
  Oligomer
cagacagagaaguccuugugg

SEQ ID NO: 6582 - RNA, 21 nt, artificial
  Oligomer
auuuaauguggcacacuggcc

SEQ ID NO: 6583 - RNA, 21 nt, artificial
  Oligomer
aagaagggcaagagaagucgu

SEQ ID NO: 6584 - RNA, 21 nt, artificial
  Oligomer
auuaagcauggagaaaaggga

SEQ ID NO: 6585 - RNA, 21 nt, artificial
  Oligomer
ugacuuucacauugaugggug

SEQ ID NO: 6586 - RNA, 21 nt, artificial
  Oligomer
aagugccuccagaagagguug

SEQ ID NO: 6587 - RNA, 21 nt, artificial
  Oligomer
uuguacauucuucgggugguc

SEQ ID NO: 6588 - RNA, 21 nt, artificial
  Oligomer
ucauauccgaaaguagggucu

SEQ ID NO: 6589 - RNA, 21 nt, artificial
  Oligomer
agauuucugcacuugaacacu

SEQ ID NO: 6590 - RNA, 21 nt, artificial
  Oligomer
uuugcuacagaaagugccugg

SEQ ID NO: 6591 - RNA, 21 nt, artificial
  Oligomer
aaaagggcaaaggaagucaaa

SEQ ID NO: 6592 - RNA, 21 nt, artificial
  Oligomer
gaagucaaaaaacugaacuag

SEQ ID NO: 6593 - RNA, 21 nt, artificial
  Oligomer
agguuguacauucuucgggug

SEQ ID NO: 6594 - RNA, 21 nt, artificial
  Oligomer
acugucuugauauagaccuug

SEQ ID NO: 6595 - RNA, 21 nt, artificial
  Oligomer
aguggauauaguuccagaugg

SEQ ID NO: 6596 - RNA, 21 nt, artificial
  Oligomer
auauccgaaaguagggucuuc

SEQ ID NO: 6597 - RNA, 21 nt, artificial
  Oligomer
uauccgaaaguagggucuucc

SEQ ID NO: 6598 - RNA, 21 nt, artificial
  Oligomer
cacaaagcacagcaugucugg

SEQ ID NO: 6599 - RNA, 21 nt, artificial
  Oligomer
acaaagcacagcaugucuggg

SEQ ID NO: 6600 - RNA, 21 nt, artificial
  Oligomer
gaacacuggauaccacucccu

SEQ ID NO: 6601 - RNA, 21 nt, artificial
  Oligomer
aacacuggauaccacucccua

SEQ ID NO: 6602 - RNA, 21 nt, artificial
  Oligomer
uuaauguggcacacuggccag

SEQ ID NO: 6603 - RNA, 21 nt, artificial
  Oligomer
aaggccuggauguguuccuug

SEQ ID NO: 6604 - RNA, 21 nt, artificial
  Oligomer
auuugcuacagaaagugccug

SEQ ID NO: 6605 - RNA, 21 nt, artificial
  Oligomer
aaucgguccuuggcugcuucu

SEQ ID NO: 6606 - RNA, 21 nt, artificial
  Oligomer
aauguagccauggucaccugg

SEQ ID NO: 6607 - RNA, 21 nt, artificial
  Oligomer
accuaagccaucuagaaaggc

SEQ ID NO: 6608 - RNA, 21 nt, artificial
  Oligomer
aaaggcucaacuuuuugggag

SEQ ID NO: 6609 - RNA, 21 nt, artificial
  Oligomer
aaccucaagcauaaaggacca

SEQ ID NO: 6610 - RNA, 21 nt, artificial
  Oligomer
uucagaaggcaaugugaccag

SEQ ID NO: 6611 - RNA, 21 nt, artificial
  Oligomer
ugaaaucuggaaaugacaggg

SEQ ID NO: 6612 - RNA, 21 nt, artificial
  Oligomer
cauuccagugaggaaaaggga

SEQ ID NO: 6613 - RNA, 21 nt, artificial
  Oligomer
aaguucacguggaccuucucu

SEQ ID NO: 6614 - RNA, 21 nt, artificial
  Oligomer
gaagagguuguacauucuucg

SEQ ID NO: 6615 - RNA, 21 nt, artificial
  Oligomer
gauauagaccuugagguuccg

SEQ ID NO: 6616 - RNA, 21 nt, artificial
  Oligomer
uggauauaguuccagauggcc

SEQ ID NO: 6617 - RNA, 21 nt, artificial
  Oligomer
auauaguuccagauggcccug

SEQ ID NO: 6618 - RNA, 21 nt, artificial
  Oligomer
uggcgaugguauuguagguga

SEQ ID NO: 6619 - RNA, 21 nt, artificial
  Oligomer
uggucuucccagguauaaucc

SEQ ID NO: 6620 - RNA, 21 nt, artificial
  Oligomer
augaaacaaaaccucagcgaa

SEQ ID NO: 6621 - RNA, 21 nt, artificial
  Oligomer
uauggaacugguagcaaagcc

SEQ ID NO: 6622 - RNA, 21 nt, artificial
  Oligomer
uugaacacuggauaccacucc

SEQ ID NO: 6623 - RNA, 21 nt, artificial
  Oligomer
uugccuuucuucagugcccuc

SEQ ID NO: 6624 - RNA, 21 nt, artificial
  Oligomer
uugcuacagaaagugccugga

SEQ ID NO: 6625 - RNA, 21 nt, artificial
  Oligomer
uacagaaagugccuggaaucg

SEQ ID NO: 6626 - RNA, 21 nt, artificial
  Oligomer
cagucagagguuuggcaaugu

SEQ ID NO: 6627 - RNA, 21 nt, artificial
  Oligomer
cuagaaaggcucaacuuuuug

SEQ ID NO: 6628 - RNA, 21 nt, artificial
  Oligomer
uuccuuggugaugagccaugg

SEQ ID NO: 6629 - RNA, 21 nt, artificial
  Oligomer
aagucaaaaaacugaacuagg

SEQ ID NO: 6630 - RNA, 21 nt, artificial
  Oligomer
aaaacugaacuaggauucggg

SEQ ID NO: 6631 - RNA, 21 nt, artificial
  Oligomer
uuucacauugaugggugaaug

SEQ ID NO: 6632 - RNA, 21 nt, artificial
  Oligomer
gagucagugcaaugaacuguc

SEQ ID NO: 6633 - RNA, 21 nt, artificial
  Oligomer
cuccagacagagaaguccuug

SEQ ID NO: 6634 - RNA, 21 nt, artificial
  Oligomer
auucuucggguggucuucucu

SEQ ID NO: 6635 - RNA, 21 nt, artificial
  Oligomer
cugucuugauauagaccuuga

SEQ ID NO: 6636 - RNA, 21 nt, artificial
  Oligomer
auagucaucauaucugaugcc

SEQ ID NO: 6637 - RNA, 21 nt, artificial
  Oligomer
uauaguuccagauggcccugc

SEQ ID NO: 6638 - RNA, 21 nt, artificial
  Oligomer
auuguaggugaggcuauaggc

SEQ ID NO: 6639 - RNA, 21 nt, artificial
  Oligomer
uucccagguauaauccugggc

SEQ ID NO: 6640 - RNA, 21 nt, artificial
  Oligomer
aacugguagcaaagccaaaga

SEQ ID NO: 6641 - RNA, 21 nt, artificial
  Oligomer
ucauuugcuacagaaagugcc

SEQ ID NO: 6642 - RNA, 21 nt, artificial
  Oligomer
cugguaaaguagucagggugc

SEQ ID NO: 6643 - RNA, 21 nt, artificial
  Oligomer
aaauccgcuugcuguuggcag

SEQ ID NO: 6644 - RNA, 21 nt, artificial
  Oligomer
gaaaggcucaacuuuuuggga

SEQ ID NO: 6645 - RNA, 21 nt, artificial
  Oligomer
ucagaaggcaaugugaccagc

SEQ ID NO: 6646 - RNA, 21 nt, artificial
  Oligomer
aaaggcucaaacucucuagag

SEQ ID NO: 6647 - RNA, 21 nt, artificial
  Oligomer
aggaagucaaaaaacugaacu

SEQ ID NO: 6648 - RNA, 21 nt, artificial
  Oligomer
aacuaggauucgggcaacagc

SEQ ID NO: 6649 - RNA, 21 nt, artificial
  Oligomer
aacaggcuuuuagggaacugg

SEQ ID NO: 6650 - RNA, 21 nt, artificial
  Oligomer
aacuggacacacagaccagcu

SEQ ID NO: 6651 - RNA, 21 nt, artificial
  Oligomer
ucacauugaugggugaauggc

SEQ ID NO: 6652 - RNA, 21 nt, artificial
  Oligomer
aaugaaaucuggaaaugacag

SEQ ID NO: 6653 - RNA, 21 nt, artificial
  Oligomer
augaaaucuggaaaugacagg

SEQ ID NO: 6654 - RNA, 21 nt, artificial
  Oligomer
gucagugcaaugaacugucca

SEQ ID NO: 6655 - RNA, 21 nt, artificial
  Oligomer
uccauuccagugaggaaaagg

SEQ ID NO: 6656 - RNA, 21 nt, artificial
  Oligomer
accagguaagaacacugaugg

SEQ ID NO: 6657 - RNA, 21 nt, artificial
  Oligomer
uguacauucuucggguggucu

SEQ ID NO: 6658 - RNA, 21 nt, artificial
  Oligomer
ugauauagaccuugagguucc

SEQ ID NO: 6659 - RNA, 21 nt, artificial
  Oligomer
auaucugaugccaaagacgca

SEQ ID NO: 6660 - RNA, 21 nt, artificial
  Oligomer
caugauggcaauguaguggcg

SEQ ID NO: 6661 - RNA, 21 nt, artificial
  Oligomer
ugcauggcgaugguauuguag

SEQ ID NO: 6662 - RNA, 21 nt, artificial
  Oligomer
ucuucccagguauaauccugg

SEQ ID NO: 6663 - RNA, 21 nt, artificial
  Oligomer
aagcacagcaugucugggugu

SEQ ID NO: 6664 - RNA, 21 nt, artificial
  Oligomer
auggaacugguagcaaagcca

SEQ ID NO: 6665 - RNA, 21 nt, artificial
  Oligomer
aaagccaaagauuucugcacu

SEQ ID NO: 6666 - RNA, 21 nt, artificial
  Oligomer
ugaacacuggauaccacuccc

SEQ ID NO: 6667 - RNA, 21 nt, artificial
  Oligomer
uucagugcccuccaaacuggu

SEQ ID NO: 6668 - RNA, 21 nt, artificial
  Oligomer
gagaagucguaauucacaguc

SEQ ID NO: 6669 - RNA, 21 nt, artificial
  Oligomer
cauuugcuacagaaagugccu

SEQ ID NO: 6670 - RNA, 21 nt, artificial
  Oligomer
caaacucucuagagauaaucu

SEQ ID NO: 6671 - RNA, 21 nt, artificial
  Oligomer
aaacucucuagagauaaucug

SEQ ID NO: 6672 - RNA, 21 nt, artificial
  Oligomer
aaaaacugaacuaggauucgg

SEQ ID NO: 6673 - RNA, 21 nt, artificial
  Oligomer
cuuuuagggaacuggacacac

SEQ ID NO: 6674 - RNA, 21 nt, artificial
  Oligomer
gacuuucacauugauggguga

SEQ ID NO: 6675 - RNA, 21 nt, artificial
  Oligomer
ugccuccagaagagguuguac

SEQ ID NO: 6676 - RNA, 21 nt, artificial
  Oligomer
gucuugauauagaccuugagg

SEQ ID NO: 6677 - RNA, 21 nt, artificial
  Oligomer
auagaccuugagguuccgcuc

SEQ ID NO: 6678 - RNA, 21 nt, artificial
  Oligomer
ucauaucugaugccaaagacg

SEQ ID NO: 6679 - RNA, 21 nt, artificial
  Oligomer
cauaucugaugccaaagacgc

SEQ ID NO: 6680 - RNA, 21 nt, artificial
  Oligomer
aucugaugccaaagacgcagu

SEQ ID NO: 6681 - RNA, 21 nt, artificial
  Oligomer
guggauauaguuccagauggc

SEQ ID NO: 6682 - RNA, 21 nt, artificial
  Oligomer
auccgaaaguagggucuucca

SEQ ID NO: 6683 - RNA, 21 nt, artificial
  Oligomer
aaagcacagcaugucugggug

SEQ ID NO: 6684 - RNA, 21 nt, artificial
  Oligomer
cucucugacuucuccagcuca

SEQ ID NO: 6685 - RNA, 21 nt, artificial
  Oligomer
caucauauggaacugguagca

SEQ ID NO: 6686 - RNA, 21 nt, artificial
  Oligomer
uuuaauguggcacacuggcca

SEQ ID NO: 6687 - RNA, 21 nt, artificial
  Oligomer
gaagaagggcaagagaagucg

SEQ ID NO: 6688 - RNA, 21 nt, artificial
  Oligomer
agucauuugcuacagaaagug

SEQ ID NO: 6689 - RNA, 21 nt, artificial
  Oligomer
cuugcaagaaaauccgcuugc

SEQ ID NO: 6690 - RNA, 21 nt, artificial
  Oligomer
aaaauccgcuugcuguuggca

SEQ ID NO: 6691 - RNA, 21 nt, artificial
  Oligomer
caauguagccauggucaccug

SEQ ID NO: 6692 - RNA, 21 nt, artificial
  Oligomer
cagaaggcaaugugaccagca

SEQ ID NO: 6693 - RNA, 21 nt, artificial
  Oligomer
aacugaacuaggauucgggca

SEQ ID NO: 6694 - RNA, 21 nt, artificial
  Oligomer
ccugacuuucacauugauggg

SEQ ID NO: 6695 - RNA, 21 nt, artificial
  Oligomer
caggaaggccacaacacuugu

SEQ ID NO: 6696 - RNA, 21 nt, artificial
  Oligomer
agugcaaugaacuguccauuc

SEQ ID NO: 6697 - RNA, 21 nt, artificial
  Oligomer
agagguuguacauucuucggg

SEQ ID NO: 6698 - RNA, 21 nt, artificial
  Oligomer
gagguuguacauucuucgggu

SEQ ID NO: 6699 - RNA, 21 nt, artificial
  Oligomer
gguuguacauucuucgggugg

SEQ ID NO: 6700 - RNA, 21 nt, artificial
  Oligomer
uacauucuucggguggucuuc

SEQ ID NO: 6701 - RNA, 21 nt, artificial
  Oligomer
cauagucaucauaucugaugc

SEQ ID NO: 6702 - RNA, 21 nt, artificial
  Oligomer
ucugaugccaaagacgcagug

SEQ ID NO: 6703 - RNA, 21 nt, artificial
  Oligomer
acgcaguggauauaguuccag

SEQ ID NO: 6704 - RNA, 21 nt, artificial
  Oligomer
aucagcgaguagccauggucu

SEQ ID NO: 6705 - RNA, 21 nt, artificial
  Oligomer
cuucccagguauaauccuggg

SEQ ID NO: 6706 - RNA, 21 nt, artificial
  Oligomer
ccgagugaaguccucauaucc

SEQ ID NO: 6707 - RNA, 21 nt, artificial
  Oligomer
aguccucauauccgaaaguag

SEQ ID NO: 6708 - RNA, 21 nt, artificial
  Oligomer
ugacuucuccagcucaaagcg

SEQ ID NO: 6709 - RNA, 21 nt, artificial
  Oligomer
acagccaaacacgaaggagga

SEQ ID NO: 6710 - RNA, 21 nt, artificial
  Oligomer
acagacugcuagaagaagggc

SEQ ID NO: 6711 - RNA, 21 nt, artificial
  Oligomer
ucuugcaagaaaauccgcuug

SEQ ID NO: 6712 - RNA, 21 nt, artificial
  Oligomer
uugcaagaaaauccgcuugcu

SEQ ID NO: 6713 - RNA, 21 nt, artificial
  Oligomer
gaaaauccgcuugcuguuggc

SEQ ID NO: 6714 - RNA, 21 nt, artificial
  Oligomer
gucagagguuuggcaauguag

SEQ ID NO: 6715 - RNA, 21 nt, artificial
  Oligomer
cagagguuuggcaauguagcc

SEQ ID NO: 6716 - RNA, 21 nt, artificial
  Oligomer
uuggcaauguagccaugguca

SEQ ID NO: 6717 - RNA, 21 nt, artificial
  Oligomer
gccagcaacuuguugaucucg

SEQ ID NO: 6718 - RNA, 21 nt, artificial
  Oligomer
uugaucucgcugaguuugcgc

SEQ ID NO: 6719 - RNA, 21 nt, artificial
  Oligomer
auuccagugaggaaaagggag

SEQ ID NO: 6720 - RNA, 21 nt, artificial
  Oligomer
uugauauagaccuugagguuc

SEQ ID NO: 6721 - RNA, 21 nt, artificial
  Oligomer
aucaccacugccagguugucu

SEQ ID NO: 6722 - RNA, 21 nt, artificial
  Oligomer
agacgcaguggauauaguucc

SEQ ID NO: 6723 - RNA, 21 nt, artificial
  Oligomer
aaguccucauauccgaaagua

SEQ ID NO: 6724 - RNA, 21 nt, artificial
  Oligomer
cucauauccgaaaguaggguc

SEQ ID NO: 6725 - RNA, 21 nt, artificial
  Oligomer
aaacuggucagagaggaggca

SEQ ID NO: 6726 - RNA, 21 nt, artificial
  Oligomer
aagagaagucguaauucacag

SEQ ID NO: 6727 - RNA, 21 nt, artificial
  Oligomer
agaagucguaauucacaguca

SEQ ID NO: 6728 - RNA, 21 nt, artificial
  Oligomer
cguaauucacagucauuugcu

SEQ ID NO: 6729 - RNA, 21 nt, artificial
  Oligomer
acagaugagauacugggaugg

SEQ ID NO: 6730 - RNA, 21 nt, artificial
  Oligomer
cagaugagauacugggauggg

SEQ ID NO: 6731 - RNA, 21 nt, artificial
  Oligomer
uguguuccuuggugaugagcc

SEQ ID NO: 6732 - RNA, 21 nt, artificial
  Oligomer
uggaaccucaagcauaaagga

SEQ ID NO: 6733 - RNA, 21 nt, artificial
  Oligomer
caaugugaccagcaaaggcuc

SEQ ID NO: 6734 - RNA, 21 nt, artificial
  Oligomer
aaugugaccagcaaaggcuca

SEQ ID NO: 6735 - RNA, 21 nt, artificial
  Oligomer
cagcaaaggcucaaacucucu

SEQ ID NO: 6736 - RNA, 21 nt, artificial
  Oligomer
aacuuguugaucucgcugagu

SEQ ID NO: 6737 - RNA, 21 nt, artificial
  Oligomer
uuuagggaacuggacacacag

SEQ ID NO: 6738 - RNA, 21 nt, artificial
  Oligomer
gugcaaugaacuguccauucc

SEQ ID NO: 6739 - RNA, 21 nt, artificial
  Oligomer
ugcaaugaacuguccauucca

SEQ ID NO: 6740 - RNA, 21 nt, artificial
  Oligomer
guucacguggaccuucucuga

SEQ ID NO: 6741 - RNA, 21 nt, artificial
  Oligomer
caggccacugucuugauauag

SEQ ID NO: 6742 - RNA, 21 nt, artificial
  Oligomer
ugucuugauauagaccuugag

SEQ ID NO: 6743 - RNA, 21 nt, artificial
  Oligomer
aucauaucugaugccaaagac

SEQ ID NO: 6744 - RNA, 21 nt, artificial
  Oligomer
gacgcaguggauauaguucca

SEQ ID NO: 6745 - RNA, 21 nt, artificial
  Oligomer
aguagggucuuccacaaagca

SEQ ID NO: 6746 - RNA, 21 nt, artificial
  Oligomer
agaguuguucaacgggucccu

SEQ ID NO: 6747 - RNA, 21 nt, artificial
  Oligomer
cacccagugaacauuuacagu

SEQ ID NO: 6748 - RNA, 21 nt, artificial
  Oligomer
gugaacauuuacagucaucac

SEQ ID NO: 6749 - RNA, 21 nt, artificial
  Oligomer
ucuccugcacaccuucuugca

SEQ ID NO: 6750 - RNA, 21 nt, artificial
  Oligomer
uccaaacuggucagagaggag

SEQ ID NO: 6751 - RNA, 21 nt, artificial
  Oligomer
agaaagugccuggaaucgguc

SEQ ID NO: 6752 - RNA, 21 nt, artificial
  Oligomer
cugggagaacagaauucuccc

SEQ ID NO: 6753 - RNA, 21 nt, artificial
  Oligomer
agacagagaaguccuuguggg

SEQ ID NO: 6754 - RNA, 21 nt, artificial
  Oligomer
uagucaucauaucugaugcca

SEQ ID NO: 6755 - RNA, 21 nt, artificial
  Oligomer
ccaaagacgcaguggauauag

SEQ ID NO: 6756 - RNA, 21 nt, artificial
  Oligomer
ccaugauggcaauguaguggc

SEQ ID NO: 6757 - RNA, 21 nt, artificial
  Oligomer
uuguaggugaggcuauaggcu

SEQ ID NO: 6758 - RNA, 21 nt, artificial
  Oligomer
uauaggcugccuggaacuucu

SEQ ID NO: 6759 - RNA, 21 nt, artificial
  Oligomer
auaggcugccuggaacuucuc

SEQ ID NO: 6760 - RNA, 21 nt, artificial
  Oligomer
uccucauauccgaaaguaggg

SEQ ID NO: 6761 - RNA, 21 nt, artificial
  Oligomer
gaagcugguaaaguagucagg

SEQ ID NO: 6762 - RNA, 21 nt, artificial
  Oligomer
ugcaagaaaauccgcuugcug

SEQ ID NO: 6763 - RNA, 21 nt, artificial
  Oligomer
gguuuggcaauguagccaugg

SEQ ID NO: 6764 - RNA, 21 nt, artificial
  Oligomer
cuaagccaucuagaaaggcuc

SEQ ID NO: 6765 - RNA, 21 nt, artificial
  Oligomer
cucugggagaacagaauucuc

SEQ ID NO: 6766 - RNA, 21 nt, artificial
  Oligomer
ucugggagaacagaauucucc

SEQ ID NO: 6767 - RNA, 21 nt, artificial
  Oligomer
aggcaaugugaccagcaaagg

SEQ ID NO: 6768 - RNA, 21 nt, artificial
  Oligomer
gcaaaggcucaaacucucuag

SEQ ID NO: 6769 - RNA, 21 nt, artificial
  Oligomer
augaacuguccauuccaguga

SEQ ID NO: 6770 - RNA, 21 nt, artificial
  Oligomer
aucacacacaagcccacugca

SEQ ID NO: 6771 - RNA, 21 nt, artificial
  Oligomer
ugucuccagacagagaagucc

SEQ ID NO: 6772 - RNA, 21 nt, artificial
  Oligomer
gucuccagacagagaaguccu

SEQ ID NO: 6773 - RNA, 21 nt, artificial
  Oligomer
uaucugaugccaaagacgcag

SEQ ID NO: 6774 - RNA, 21 nt, artificial
  Oligomer
cagaagcugguaaaguaguca

SEQ ID NO: 6775 - RNA, 21 nt, artificial
  Oligomer
agaagcugguaaaguagucag

SEQ ID NO: 6776 - RNA, 21 nt, artificial
  Oligomer
uucagcaaggccuggaugugu

SEQ ID NO: 6777 - RNA, 21 nt, artificial
  Oligomer
acagaaagugccuggaaucgg

SEQ ID NO: 6778 - RNA, 21 nt, artificial
  Oligomer
agcaacuuguugaucucgcug

SEQ ID NO: 6779 - RNA, 21 nt, artificial
  Oligomer
gaacaggcuuuuagggaacug

SEQ ID NO: 6780 - RNA, 21 nt, artificial
  Oligomer
uaggaucuccaagugcucuuc

SEQ ID NO: 6781 - RNA, 21 nt, artificial
  Oligomer
guauuguaggugaggcuauag

SEQ ID NO: 6782 - RNA, 21 nt, artificial
  Oligomer
gcaaagccaaagauuucugca

SEQ ID NO: 6783 - RNA, 21 nt, artificial
  Oligomer
agccaaagauuucugcacuug

SEQ ID NO: 6784 - RNA, 21 nt, artificial
  Oligomer
agugaacauuuacagucauca

SEQ ID NO: 6785 - RNA, 21 nt, artificial
  Oligomer
uuuggcaauguagccaugguc

SEQ ID NO: 6786 - RNA, 21 nt, artificial
  Oligomer
caggguccaaacaagaacccu

SEQ ID NO: 6787 - RNA, 21 nt, artificial
  Oligomer
aaacaagaacccuggugccuc

SEQ ID NO: 6788 - RNA, 21 nt, artificial
  Oligomer
uccagguuggaaccucaagca

SEQ ID NO: 6789 - RNA, 21 nt, artificial
  Oligomer
gaaaaagggcaaaggaaguca

SEQ ID NO: 6790 - RNA, 21 nt, artificial
  Oligomer
acaggcuuuuagggaacugga

SEQ ID NO: 6791 - RNA, 21 nt, artificial
  Oligomer
ucccuuaggaucuccaagugc

SEQ ID NO: 6792 - RNA, 21 nt, artificial
  Oligomer
ugaacuguccauuccagugag

SEQ ID NO: 6793 - RNA, 21 nt, artificial
  Oligomer
gaacuguccauuccagugagg

SEQ ID NO: 6794 - RNA, 21 nt, artificial
  Oligomer
caugggacacaaaagggucug

SEQ ID NO: 6795 - RNA, 21 nt, artificial
  Oligomer
cugucuccagacagagaaguc

SEQ ID NO: 6796 - RNA, 21 nt, artificial
  Oligomer
ccagguaagaacacugauggc

SEQ ID NO: 6797 - RNA, 21 nt, artificial
  Oligomer
cagguaagaacacugauggcg

SEQ ID NO: 6798 - RNA, 21 nt, artificial
  Oligomer
augguauuguaggugaggcua

SEQ ID NO: 6799 - RNA, 21 nt, artificial
  Oligomer
uauuguaggugaggcuauagg

SEQ ID NO: 6800 - RNA, 21 nt, artificial
  Oligomer
uggaagcaacccacuuaagcc

SEQ ID NO: 6801 - RNA, 21 nt, artificial
  Oligomer
uccucuucagaaggcaaugug

SEQ ID NO: 6802 - RNA, 21 nt, artificial
  Oligomer
ccauuaagcauggagaaaagg

SEQ ID NO: 6803 - RNA, 21 nt, artificial
  Oligomer
aaggccacaacacuuguggca

SEQ ID NO: 6804 - RNA, 21 nt, artificial
  Oligomer
aggaucuccaagugcucuucc

SEQ ID NO: 6805 - RNA, 21 nt, artificial
  Oligomer
uucuucggguggucuucucug

SEQ ID NO: 6806 - RNA, 21 nt, artificial
  Oligomer
uaggcugccuggaacuucuca

SEQ ID NO: 6807 - RNA, 21 nt, artificial
  Oligomer
agggucuuccacaaagcacag

SEQ ID NO: 6808 - RNA, 21 nt, artificial
  Oligomer
gccucacaccauuaagcaugg

SEQ ID NO: 6809 - RNA, 21 nt, artificial
  Oligomer
ugccuggaacuucucauccag

SEQ ID NO: 6810 - RNA, 21 nt, artificial
  Oligomer
gagaacagaauucucccucuc

SEQ ID NO: 6811 - RNA, 21 nt, artificial
  Oligomer
guugaucucgcugaguuugcg

SEQ ID NO: 6812 - RNA, 21 nt, artificial
  Oligomer
aaugaacuguccauuccagug

SEQ ID NO: 6813 - RNA, 21 nt, artificial
  Oligomer
aacuguccauuccagugagga

SEQ ID NO: 6814 - RNA, 21 nt, artificial
  Oligomer
uuccagugaggaaaagggagg

SEQ ID NO: 6815 - RNA, 21 nt, artificial
  Oligomer
uacucccuccucuucagaagg

SEQ ID NO: 6816 - RNA, 19 nt, artificial
  Oligomer
gaaucacagaaacacuuuu

SEQ ID NO: 6817 - RNA, 19 nt, artificial
  Oligomer
ccguggucuauaucgagau

SEQ ID NO: 6818 - RNA, 19 nt, artificial
  Oligomer
gacauggguuucuugguaa

SEQ ID NO: 6819 - RNA, 19 nt, artificial
  Oligomer
ccgagacagaggguuaaau

SEQ ID NO: 6820 - RNA, 19 nt, artificial
  Oligomer
gaugguacaaaaugcugaa

SEQ ID NO: 6821 - RNA, 19 nt, artificial
  Oligomer
cguggucuauaucgagauc

SEQ ID NO: 6822 - RNA, 19 nt, artificial
  Oligomer
gccguggucuauaucgaga

SEQ ID NO: 6823 - RNA, 19 nt, artificial
  Oligomer
gugcugcucuuuguggugu

SEQ ID NO: 6824 - RNA, 19 nt, artificial
  Oligomer
aggauucagacuaaguuug

SEQ ID NO: 6825 - RNA, 19 nt, artificial
  Oligomer
ggugaaaacuucugcuuga

SEQ ID NO: 6826 - RNA, 19 nt, artificial
  Oligomer
ccugcucugauuuccuccu

SEQ ID NO: 6827 - RNA, 19 nt, artificial
  Oligomer
ugagugcgguugcugacau

SEQ ID NO: 6828 - RNA, 19 nt, artificial
  Oligomer
agggugaaaacuucugcuu

SEQ ID NO: 6829 - RNA, 19 nt, artificial
  Oligomer
gucaggugcugcucuuugu

SEQ ID NO: 6830 - RNA, 19 nt, artificial
  Oligomer
gugaugugauuuuggccau

SEQ ID NO: 6831 - RNA, 19 nt, artificial
  Oligomer
gccuggugaugugauuuug

SEQ ID NO: 6832 - RNA, 19 nt, artificial
  Oligomer
cugccguggucuauaucga

SEQ ID NO: 6833 - RNA, 19 nt, artificial
  Oligomer
caucuuuugugggcaguua

SEQ ID NO: 6834 - RNA, 19 nt, artificial
  Oligomer
ggugaugugauuuuggcca

SEQ ID NO: 6835 - RNA, 19 nt, artificial
  Oligomer
gcugcugccaucuuuugug

SEQ ID NO: 6836 - RNA, 19 nt, artificial
  Oligomer
accauccugaccuccuauu

SEQ ID NO: 6837 - RNA, 19 nt, artificial
  Oligomer
ugguacaaaaugcugaaga

SEQ ID NO: 6838 - RNA, 19 nt, artificial
  Oligomer
gagggugaaaacuucugcu

SEQ ID NO: 6839 - RNA, 19 nt, artificial
  Oligomer
gccucagagaacucuggaa

SEQ ID NO: 6840 - RNA, 19 nt, artificial
  Oligomer
aggucacagaaugaauaga

SEQ ID NO: 6841 - RNA, 19 nt, artificial
  Oligomer
uugcugacauggguuucuu

SEQ ID NO: 6842 - RNA, 19 nt, artificial
  Oligomer
ccauagugcauggucugau

SEQ ID NO: 6843 - RNA, 19 nt, artificial
  Oligomer
cugcugacgucaggaacuu

SEQ ID NO: 6844 - RNA, 19 nt, artificial
  Oligomer
cucugaagaaucacagaaa

SEQ ID NO: 6845 - RNA, 19 nt, artificial
  Oligomer
cgcugaggauucagacuaa

SEQ ID NO: 6846 - RNA, 19 nt, artificial
  Oligomer
cccggagucaguacaacuu

SEQ ID NO: 6847 - RNA, 19 nt, artificial
  Oligomer
acgcugaggauucagacua

SEQ ID NO: 6848 - RNA, 19 nt, artificial
  Oligomer
gcucugaagaaucacagaa

SEQ ID NO: 6849 - RNA, 19 nt, artificial
  Oligomer
aggguuaaaugaaccagug

SEQ ID NO: 6850 - RNA, 19 nt, artificial
  Oligomer
gugcacuucugaaggacuu

SEQ ID NO: 6851 - RNA, 19 nt, artificial
  Oligomer
ccucagagaacucuggaac

SEQ ID NO: 6852 - RNA, 19 nt, artificial
  Oligomer
gaggguuaaaugaaccagu

SEQ ID NO: 6853 - RNA, 19 nt, artificial
  Oligomer
ccaagaguaugaggcuccu

SEQ ID NO: 6854 - RNA, 19 nt, artificial
  Oligomer
cagaaugaauagaucacca

SEQ ID NO: 6855 - RNA, 19 nt, artificial
  Oligomer
ucccaugcuuggcuacaga

SEQ ID NO: 6856 - RNA, 19 nt, artificial
  Oligomer
gggcucugaagaaucacag

SEQ ID NO: 6857 - RNA, 19 nt, artificial
  Oligomer
cuccugggcucugaagaau

SEQ ID NO: 6858 - RNA, 19 nt, artificial
  Oligomer
gacuaaguuuggaaacucu

SEQ ID NO: 6859 - RNA, 19 nt, artificial
  Oligomer
aaaaguguuucugugauuc

SEQ ID NO: 6860 - RNA, 19 nt, artificial
  Oligomer
aucucgauauagaccacgg

SEQ ID NO: 6861 - RNA, 19 nt, artificial
  Oligomer
uuaccaagaaacccauguc

SEQ ID NO: 6862 - RNA, 19 nt, artificial
  Oligomer
auuuaacccucugucucgg

SEQ ID NO: 6863 - RNA, 19 nt, artificial
  Oligomer
uucagcauuuuguaccauc

SEQ ID NO: 6864 - RNA, 19 nt, artificial
  Oligomer
gaucucgauauagaccacg

SEQ ID NO: 6865 - RNA, 19 nt, artificial
  Oligomer
ucucgauauagaccacggc

SEQ ID NO: 6866 - RNA, 19 nt, artificial
  Oligomer
acaccacaaagagcagcac

SEQ ID NO: 6867 - RNA, 19 nt, artificial
  Oligomer
caaacuuagucugaauccu

SEQ ID NO: 6868 - RNA, 19 nt, artificial
  Oligomer
ucaagcagaaguuuucacc

SEQ ID NO: 6869 - RNA, 19 nt, artificial
  Oligomer
aggaggaaaucagagcagg

SEQ ID NO: 6870 - RNA, 19 nt, artificial
  Oligomer
augucagcaaccgcacuca

SEQ ID NO: 6871 - RNA, 19 nt, artificial
  Oligomer
aagcagaaguuuucacccu

SEQ ID NO: 6872 - RNA, 19 nt, artificial
  Oligomer
acaaagagcagcaccugac

SEQ ID NO: 6873 - RNA, 19 nt, artificial
  Oligomer
auggccaaaaucacaucac

SEQ ID NO: 6874 - RNA, 19 nt, artificial
  Oligomer
caaaaucacaucaccaggc

SEQ ID NO: 6875 - RNA, 19 nt, artificial
  Oligomer
ucgauauagaccacggcag

SEQ ID NO: 6876 - RNA, 19 nt, artificial
  Oligomer
uaacugcccacaaaagaug

SEQ ID NO: 6877 - RNA, 19 nt, artificial
  Oligomer
uggccaaaaucacaucacc

SEQ ID NO: 6878 - RNA, 19 nt, artificial
  Oligomer
cacaaaagauggcagcagc

SEQ ID NO: 6879 - RNA, 19 nt, artificial
  Oligomer
aauaggaggucaggauggu

SEQ ID NO: 6880 - RNA, 19 nt, artificial
  Oligomer
ucuucagcauuuuguacca

SEQ ID NO: 6881 - RNA, 19 nt, artificial
  Oligomer
agcagaaguuuucacccuc

SEQ ID NO: 6882 - RNA, 19 nt, artificial
  Oligomer
uuccagaguucucugaggc

SEQ ID NO: 6883 - RNA, 19 nt, artificial
  Oligomer
ucuauucauucugugaccu

SEQ ID NO: 6884 - RNA, 19 nt, artificial
  Oligomer
aagaaacccaugucagcaa

SEQ ID NO: 6885 - RNA, 19 nt, artificial
  Oligomer
aucagaccaugcacuaugg

SEQ ID NO: 6886 - RNA, 19 nt, artificial
  Oligomer
aaguuccugacgucagcag

SEQ ID NO: 6887 - RNA, 19 nt, artificial
  Oligomer
uuucugugauucuucagag

SEQ ID NO: 6888 - RNA, 19 nt, artificial
  Oligomer
uuagucugaauccucagcg

SEQ ID NO: 6889 - RNA, 19 nt, artificial
  Oligomer
aaguuguacugacuccggg

SEQ ID NO: 6890 - RNA, 19 nt, artificial
  Oligomer
uagucugaauccucagcgu

SEQ ID NO: 6891 - RNA, 19 nt, artificial
  Oligomer
uucugugauucuucagagc

SEQ ID NO: 6892 - RNA, 19 nt, artificial
  Oligomer
cacugguucauuuaacccu

SEQ ID NO: 6893 - RNA, 19 nt, artificial
  Oligomer
aaguccuucagaagugcac

SEQ ID NO: 6894 - RNA, 19 nt, artificial
  Oligomer
guuccagaguucucugagg

SEQ ID NO: 6895 - RNA, 19 nt, artificial
  Oligomer
acugguucauuuaacccuc

SEQ ID NO: 6896 - RNA, 19 nt, artificial
  Oligomer
aggagccucauacucuugg

SEQ ID NO: 6897 - RNA, 19 nt, artificial
  Oligomer
uggugaucuauucauucug

SEQ ID NO: 6898 - RNA, 19 nt, artificial
  Oligomer
ucuguagccaagcauggga

SEQ ID NO: 6899 - RNA, 19 nt, artificial
  Oligomer
cugugauucuucagagccc

SEQ ID NO: 6900 - RNA, 19 nt, artificial
  Oligomer
auucuucagagcccaggag

SEQ ID NO: 6901 - RNA, 19 nt, artificial
  Oligomer
agaguuuccaaacuuaguc

SEQ ID NO: 6902 - RNA, 19 nt, artificial
  Oligomer
gcacugcaaauaacccauc

SEQ ID NO: 6903 - RNA, 19 nt, artificial
  Oligomer
acugcaaauaacccaucuu

SEQ ID NO: 6904 - RNA, 19 nt, artificial
  Oligomer
ggaugccucaguguuaaaa

SEQ ID NO: 6905 - RNA, 19 nt, artificial
  Oligomer
cacugcaaauaacccaucu

SEQ ID NO: 6906 - RNA, 19 nt, artificial
  Oligomer
gggcaaaaauacaguccaa

SEQ ID NO: 6907 - RNA, 19 nt, artificial
  Oligomer
ugauaaguaacccuguaau

SEQ ID NO: 6908 - RNA, 19 nt, artificial
  Oligomer
ggaguaucauuguuuuugu

SEQ ID NO: 6909 - RNA, 19 nt, artificial
  Oligomer
gccucauugaauucgccua

SEQ ID NO: 6910 - RNA, 19 nt, artificial
  Oligomer
gcagcugucaccaugugau

SEQ ID NO: 6911 - RNA, 19 nt, artificial
  Oligomer
ggcaaaaauacaguccaau

SEQ ID NO: 6912 - RNA, 19 nt, artificial
  Oligomer
caccaugugauuuauucuu

SEQ ID NO: 6913 - RNA, 19 nt, artificial
  Oligomer
cgggacuaaaagaaaagac

SEQ ID NO: 6914 - RNA, 19 nt, artificial
  Oligomer
gggacuaaaagaaaagaca

SEQ ID NO: 6915 - RNA, 19 nt, artificial
  Oligomer
ccgggacuaaaagaaaaga

SEQ ID NO: 6916 - RNA, 19 nt, artificial
  Oligomer
gggaguaucauuguuuuug

SEQ ID NO: 6917 - RNA, 19 nt, artificial
  Oligomer
cucauugaauucgccuaca

SEQ ID NO: 6918 - RNA, 19 nt, artificial
  Oligomer
caucucaaaagaaguccaa

SEQ ID NO: 6919 - RNA, 19 nt, artificial
  Oligomer
guguuaaaaugacaucuca

SEQ ID NO: 6920 - RNA, 19 nt, artificial
  Oligomer
cucaguguuaaaaugacau

SEQ ID NO: 6921 - RNA, 19 nt, artificial
  Oligomer
ccucaguguuaaaaugaca

SEQ ID NO: 6922 - RNA, 19 nt, artificial
  Oligomer
ccuuaauucagcugagugu

SEQ ID NO: 6923 - RNA, 19 nt, artificial
  Oligomer
cccgggaguacaucuacau

SEQ ID NO: 6924 - RNA, 19 nt, artificial
  Oligomer
ccucauugaauucgccuac

SEQ ID NO: 6925 - RNA, 19 nt, artificial
  Oligomer
accgggacuaaaagaaaag

SEQ ID NO: 6926 - RNA, 19 nt, artificial
  Oligomer
ccucaaucgucuccuuuau

SEQ ID NO: 6927 - RNA, 19 nt, artificial
  Oligomer
cugucuucaaggccauguu

SEQ ID NO: 6928 - RNA, 19 nt, artificial
  Oligomer
acgucacacugcaggucaa

SEQ ID NO: 6929 - RNA, 19 nt, artificial
  Oligomer
aaccgggacuaaaagaaaa

SEQ ID NO: 6930 - RNA, 19 nt, artificial
  Oligomer
ugaggcacuuuuguuucuu

SEQ ID NO: 6931 - RNA, 19 nt, artificial
  Oligomer
agaggaacgaguggcgaau

SEQ ID NO: 6932 - RNA, 19 nt, artificial
  Oligomer
caguguuaaaaugacaucu

SEQ ID NO: 6933 - RNA, 19 nt, artificial
  Oligomer
agcgcuacgauguggaaac

SEQ ID NO: 6934 - RNA, 19 nt, artificial
  Oligomer
acaguguggagagguauga

SEQ ID NO: 6935 - RNA, 19 nt, artificial
  Oligomer
gguguccauugaggguauc

SEQ ID NO: 6936 - RNA, 19 nt, artificial
  Oligomer
gaggcacuuuuguuucuug

SEQ ID NO: 6937 - RNA, 19 nt, artificial
  Oligomer
ccuuuggcaucaugaacga

SEQ ID NO: 6938 - RNA, 19 nt, artificial
  Oligomer
uccugcacaacuguaucua

SEQ ID NO: 6939 - RNA, 19 nt, artificial
  Oligomer
agguggugguguugcuuau

SEQ ID NO: 6940 - RNA, 19 nt, artificial
  Oligomer
gcugucaccaugugauuua

SEQ ID NO: 6941 - RNA, 19 nt, artificial
  Oligomer
gccucaguguuaaaaugac

SEQ ID NO: 6942 - RNA, 19 nt, artificial
  Oligomer
ugcaucaacugggucaagu

SEQ ID NO: 6943 - RNA, 19 nt, artificial
  Oligomer
uggugguguugcuuaucuu

SEQ ID NO: 6944 - RNA, 19 nt, artificial
  Oligomer
uggacaguuauuuuguuga

SEQ ID NO: 6945 - RNA, 19 nt, artificial
  Oligomer
uuuguuucuugggcaaaaa

SEQ ID NO: 6946 - RNA, 19 nt, artificial
  Oligomer
gcaaugaacaccauccgaa

SEQ ID NO: 6947 - RNA, 19 nt, artificial
  Oligomer
ccaaggaaaauaaagaaca

SEQ ID NO: 6948 - RNA, 19 nt, artificial
  Oligomer
guccugcacaacuguaucu

SEQ ID NO: 6949 - RNA, 19 nt, artificial
  Oligomer
gauggguuauuugcagugc

SEQ ID NO: 6950 - RNA, 19 nt, artificial
  Oligomer
aagauggguuauuugcagu

SEQ ID NO: 6951 - RNA, 19 nt, artificial
  Oligomer
uuuuaacacugaggcaucc

SEQ ID NO: 6952 - RNA, 19 nt, artificial
  Oligomer
agauggguuauuugcagug

SEQ ID NO: 6953 - RNA, 19 nt, artificial
  Oligomer
uuggacuguauuuuugccc

SEQ ID NO: 6954 - RNA, 19 nt, artificial
  Oligomer
auuacaggguuacuuauca

SEQ ID NO: 6955 - RNA, 19 nt, artificial
  Oligomer
acaaaaacaaugauacucc

SEQ ID NO: 6956 - RNA, 19 nt, artificial
  Oligomer
uaggcgaauucaaugaggc

SEQ ID NO: 6957 - RNA, 19 nt, artificial
  Oligomer
aucacauggugacagcugc

SEQ ID NO: 6958 - RNA, 19 nt, artificial
  Oligomer
auuggacuguauuuuugcc

SEQ ID NO: 6959 - RNA, 19 nt, artificial
  Oligomer
aagaauaaaucacauggug

SEQ ID NO: 6960 - RNA, 19 nt, artificial
  Oligomer
gucuuuucuuuuagucccg

SEQ ID NO: 6961 - RNA, 19 nt, artificial
  Oligomer
ugucuuuucuuuuaguccc

SEQ ID NO: 6962 - RNA, 19 nt, artificial
  Oligomer
ucuuuucuuuuagucccgg

SEQ ID NO: 6963 - RNA, 19 nt, artificial
  Oligomer
caaaaacaaugauacuccc

SEQ ID NO: 6964 - RNA, 19 nt, artificial
  Oligomer
uguaggcgaauucaaugag

SEQ ID NO: 6965 - RNA, 19 nt, artificial
  Oligomer
uuggacuucuuuugagaug

SEQ ID NO: 6966 - RNA, 19 nt, artificial
  Oligomer
ugagaugucauuuuaacac

SEQ ID NO: 6967 - RNA, 19 nt, artificial
  Oligomer
augucauuuuaacacugag

SEQ ID NO: 6968 - RNA, 19 nt, artificial
  Oligomer
ugucauuuuaacacugagg

SEQ ID NO: 6969 - RNA, 19 nt, artificial
  Oligomer
acacucagcugaauuaagg

SEQ ID NO: 6970 - RNA, 19 nt, artificial
  Oligomer
auguagauguacucccggg

SEQ ID NO: 6971 - RNA, 19 nt, artificial
  Oligomer
guaggcgaauucaaugagg

SEQ ID NO: 6972 - RNA, 19 nt, artificial
  Oligomer
cuuuucuuuuagucccggu

SEQ ID NO: 6973 - RNA, 19 nt, artificial
  Oligomer
auaaaggagacgauugagg

SEQ ID NO: 6974 - RNA, 19 nt, artificial
  Oligomer
aacauggccuugaagacag

SEQ ID NO: 6975 - RNA, 19 nt, artificial
  Oligomer
uugaccugcagugugacgu

SEQ ID NO: 6976 - RNA, 19 nt, artificial
  Oligomer
uuuucuuuuagucccgguu

SEQ ID NO: 6977 - RNA, 19 nt, artificial
  Oligomer
aagaaacaaaagugccuca

SEQ ID NO: 6978 - RNA, 19 nt, artificial
  Oligomer
auucgccacucguuccucu

SEQ ID NO: 6979 - RNA, 19 nt, artificial
  Oligomer
agaugucauuuuaacacug

SEQ ID NO: 6980 - RNA, 19 nt, artificial
  Oligomer
guuuccacaucguagcgcu

SEQ ID NO: 6981 - RNA, 19 nt, artificial
  Oligomer
ucauaccucuccacacugu

SEQ ID NO: 6982 - RNA, 19 nt, artificial
  Oligomer
gauacccucaauggacacc

SEQ ID NO: 6983 - RNA, 19 nt, artificial
  Oligomer
caagaaacaaaagugccuc

SEQ ID NO: 6984 - RNA, 19 nt, artificial
  Oligomer
ucguucaugaugccaaagg

SEQ ID NO: 6985 - RNA, 19 nt, artificial
  Oligomer
uagauacaguugugcagga

SEQ ID NO: 6986 - RNA, 19 nt, artificial
  Oligomer
auaagcaacaccaccaccu

SEQ ID NO: 6987 - RNA, 19 nt, artificial
  Oligomer
uaaaucacauggugacagc

SEQ ID NO: 6988 - RNA, 19 nt, artificial
  Oligomer
gucauuuuaacacugaggc

SEQ ID NO: 6989 - RNA, 19 nt, artificial
  Oligomer
acuugacccaguugaugca

SEQ ID NO: 6990 - RNA, 19 nt, artificial
  Oligomer
aagauaagcaacaccacca

SEQ ID NO: 6991 - RNA, 19 nt, artificial
  Oligomer
ucaacaaaauaacugucca

SEQ ID NO: 6992 - RNA, 19 nt, artificial
  Oligomer
uuuuugcccaagaaacaaa

SEQ ID NO: 6993 - RNA, 19 nt, artificial
  Oligomer
uucggaugguguucauugc

SEQ ID NO: 6994 - RNA, 19 nt, artificial
  Oligomer
uguucuuuauuuuccuugg

SEQ ID NO: 6995 - RNA, 19 nt, artificial
  Oligomer
agauacaguugugcaggac

SEQ ID NO: 6996 - RNA, 19 nt, artificial
  Oligomer
ugccuuauaaccugccuuu

SEQ ID NO: 6997 - RNA, 19 nt, artificial
  Oligomer
gugccuuauaaccugccuu

SEQ ID NO: 6998 - RNA, 19 nt, artificial
  Oligomer
gggaauuucuggugacaua

SEQ ID NO: 6999 - RNA, 19 nt, artificial
  Oligomer
ccaugauauaaucugaaag

SEQ ID NO: 7000 - RNA, 19 nt, artificial
  Oligomer
gagagucauuguuugcaau

SEQ ID NO: 7001 - RNA, 19 nt, artificial
  Oligomer
gaaaauggcagacaauuuu

SEQ ID NO: 7002 - RNA, 19 nt, artificial
  Oligomer
agcggaaaauggcagacaa

SEQ ID NO: 7003 - RNA, 19 nt, artificial
  Oligomer
ggguuaaaaaacucaauga

SEQ ID NO: 7004 - RNA, 19 nt, artificial
  Oligomer
cggguuaaaaaacucaaug

SEQ ID NO: 7005 - RNA, 19 nt, artificial
  Oligomer
caagguugcagugaaugau

SEQ ID NO: 7006 - RNA, 19 nt, artificial
  Oligomer
gaccucaccagugcuucau

SEQ ID NO: 7007 - RNA, 19 nt, artificial
  Oligomer
cuuuaacccacgcuucaau

SEQ ID NO: 7008 - RNA, 19 nt, artificial
  Oligomer
aagaaagacagucgguuuu

SEQ ID NO: 7009 - RNA, 19 nt, artificial
  Oligomer
gagcggaaaauggcagaca

SEQ ID NO: 7010 - RNA, 19 nt, artificial
  Oligomer
ugcguuaucugggucugga

SEQ ID NO: 7011 - RNA, 19 nt, artificial
  Oligomer
cccucuuguaagucaucua

SEQ ID NO: 7012 - RNA, 19 nt, artificial
  Oligomer
cugggaauuucuggugaca

SEQ ID NO: 7013 - RNA, 19 nt, artificial
  Oligomer
aguacaaucaucggguuaa

SEQ ID NO: 7014 - RNA, 19 nt, artificial
  Oligomer
gucauuguuugcaauacaa

SEQ ID NO: 7015 - RNA, 19 nt, artificial
  Oligomer
gguuucauguucacuguga

SEQ ID NO: 7016 - RNA, 19 nt, artificial
  Oligomer
ugcaauacaaagcuggaua

SEQ ID NO: 7017 - RNA, 19 nt, artificial
  Oligomer
cacgcuucaaugagaacaa

SEQ ID NO: 7018 - RNA, 19 nt, artificial
  Oligomer
gggaagggaagaaagacag

SEQ ID NO: 7019 - RNA, 19 nt, artificial
  Oligomer
gcuucauauaccaugauau

SEQ ID NO: 7020 - RNA, 19 nt, artificial
  Oligomer
cuucaagguugcagugaau

SEQ ID NO: 7021 - RNA, 19 nt, artificial
  Oligomer
ccacgcuucaaugagaaca

SEQ ID NO: 7022 - RNA, 19 nt, artificial
  Oligomer
ucccucuuguaagucaucu

SEQ ID NO: 7023 - RNA, 19 nt, artificial
  Oligomer
acagucgguuuucccauuu

SEQ ID NO: 7024 - RNA, 19 nt, artificial
  Oligomer
acgcuucaaugagaacaac

SEQ ID NO: 7025 - RNA, 19 nt, artificial
  Oligomer
agucauuguuugcaauaca

SEQ ID NO: 7026 - RNA, 19 nt, artificial
  Oligomer
acccacgcuucaaugagaa

SEQ ID NO: 7027 - RNA, 19 nt, artificial
  Oligomer
gagggaaugauguugccuu

SEQ ID NO: 7028 - RNA, 19 nt, artificial
  Oligomer
cucaaugaaaucagcaaac

SEQ ID NO: 7029 - RNA, 19 nt, artificial
  Oligomer
cccauuugaaagugggaaa

SEQ ID NO: 7030 - RNA, 19 nt, artificial
  Oligomer
gccacugauugugccuuau

SEQ ID NO: 7031 - RNA, 19 nt, artificial
  Oligomer
ccucuuguaagucaucuac

SEQ ID NO: 7032 - RNA, 19 nt, artificial
  Oligomer
cuaaaccuuacauguguaa

SEQ ID NO: 7033 - RNA, 19 nt, artificial
  Oligomer
gugcuucauauaccaugau

SEQ ID NO: 7034 - RNA, 19 nt, artificial
  Oligomer
cagucgguuuucccauuug

SEQ ID NO: 7035 - RNA, 19 nt, artificial
  Oligomer
ggaaacccaaacccucaag

SEQ ID NO: 7036 - RNA, 19 nt, artificial
  Oligomer
cucacuuguugcaguacaa

SEQ ID NO: 7037 - RNA, 19 nt, artificial
  Oligomer
auguugccuuccacuuuaa

SEQ ID NO: 7038 - RNA, 19 nt, artificial
  Oligomer
cagccaacgagcggaaaau

SEQ ID NO: 7039 - RNA, 19 nt, artificial
  Oligomer
cgcuccaugaugcguuauc

SEQ ID NO: 7040 - RNA, 19 nt, artificial
  Oligomer
ucggguuaaaaaacucaau

SEQ ID NO: 7041 - RNA, 19 nt, artificial
  Oligomer
ccauuugaaagugggaaac

SEQ ID NO: 7042 - RNA, 19 nt, artificial
  Oligomer
gguuuucccauuugaaagu

SEQ ID NO: 7043 - RNA, 19 nt, artificial
  Oligomer
gagucauuguuugcaauac

SEQ ID NO: 7044 - RNA, 19 nt, artificial
  Oligomer
aaaggcagguuauaaggca

SEQ ID NO: 7045 - RNA, 19 nt, artificial
  Oligomer
aaggcagguuauaaggcac

SEQ ID NO: 7046 - RNA, 19 nt, artificial
  Oligomer
uaugucaccagaaauuccc

SEQ ID NO: 7047 - RNA, 19 nt, artificial
  Oligomer
cuuucagauuauaucaugg

SEQ ID NO: 7048 - RNA, 19 nt, artificial
  Oligomer
auugcaaacaaugacucuc

SEQ ID NO: 7049 - RNA, 19 nt, artificial
  Oligomer
aaaauugucugccauuuuc

SEQ ID NO: 7050 - RNA, 19 nt, artificial
  Oligomer
uugucugccauuuuccgcu

SEQ ID NO: 7051 - RNA, 19 nt, artificial
  Oligomer
ucauugaguuuuuuaaccc

SEQ ID NO: 7052 - RNA, 19 nt, artificial
  Oligomer
cauugaguuuuuuaacccg

SEQ ID NO: 7053 - RNA, 19 nt, artificial
  Oligomer
aucauucacugcaaccuug

SEQ ID NO: 7054 - RNA, 19 nt, artificial
  Oligomer
augaagcacuggugagguc

SEQ ID NO: 7055 - RNA, 19 nt, artificial
  Oligomer
auugaagcguggguuaaag

SEQ ID NO: 7056 - RNA, 19 nt, artificial
  Oligomer
aaaaccgacugucuuucuu

SEQ ID NO: 7057 - RNA, 19 nt, artificial
  Oligomer
ugucugccauuuuccgcuc

SEQ ID NO: 7058 - RNA, 19 nt, artificial
  Oligomer
uccagacccagauaacgca

SEQ ID NO: 7059 - RNA, 19 nt, artificial
  Oligomer
uagaugacuuacaagaggg

SEQ ID NO: 7060 - RNA, 19 nt, artificial
  Oligomer
ugucaccagaaauucccag

SEQ ID NO: 7061 - RNA, 19 nt, artificial
  Oligomer
uuaacccgaugauuguacu

SEQ ID NO: 7062 - RNA, 19 nt, artificial
  Oligomer
uuguauugcaaacaaugac

SEQ ID NO: 7063 - RNA, 19 nt, artificial
  Oligomer
ucacagugaacaugaaacc

SEQ ID NO: 7064 - RNA, 19 nt, artificial
  Oligomer
uauccagcuuuguauugca

SEQ ID NO: 7065 - RNA, 19 nt, artificial
  Oligomer
uuguucucauugaagcgug

SEQ ID NO: 7066 - RNA, 19 nt, artificial
  Oligomer
cugucuuucuucccuuccc

SEQ ID NO: 7067 - RNA, 19 nt, artificial
  Oligomer
auaucaugguauaugaagc

SEQ ID NO: 7068 - RNA, 19 nt, artificial
  Oligomer
auucacugcaaccuugaag

SEQ ID NO: 7069 - RNA, 19 nt, artificial
  Oligomer
uguucucauugaagcgugg

SEQ ID NO: 7070 - RNA, 19 nt, artificial
  Oligomer
agaugacuuacaagaggga

SEQ ID NO: 7071 - RNA, 19 nt, artificial
  Oligomer
aaaugggaaaaccgacugu

SEQ ID NO: 7072 - RNA, 19 nt, artificial
  Oligomer
guuguucucauugaagcgu

SEQ ID NO: 7073 - RNA, 19 nt, artificial
  Oligomer
uguauugcaaacaaugacu

SEQ ID NO: 7074 - RNA, 19 nt, artificial
  Oligomer
uucucauugaagcgugggu

SEQ ID NO: 7075 - RNA, 19 nt, artificial
  Oligomer
aaggcaacaucauucccuc

SEQ ID NO: 7076 - RNA, 19 nt, artificial
  Oligomer
guuugcugauuucauugag

SEQ ID NO: 7077 - RNA, 19 nt, artificial
  Oligomer
uuucccacuuucaaauggg

SEQ ID NO: 7078 - RNA, 19 nt, artificial
  Oligomer
auaaggcacaaucaguggc

SEQ ID NO: 7079 - RNA, 19 nt, artificial
  Oligomer
guagaugacuuacaagagg

SEQ ID NO: 7080 - RNA, 19 nt, artificial
  Oligomer
uuacacauguaagguuuag

SEQ ID NO: 7081 - RNA, 19 nt, artificial
  Oligomer
aucaugguauaugaagcac

SEQ ID NO: 7082 - RNA, 19 nt, artificial
  Oligomer
caaaugggaaaaccgacug

SEQ ID NO: 7083 - RNA, 19 nt, artificial
  Oligomer
cuugaggguuuggguuucc

SEQ ID NO: 7084 - RNA, 19 nt, artificial
  Oligomer
uuguacugcaacaagugag

SEQ ID NO: 7085 - RNA, 19 nt, artificial
  Oligomer
uuaaaguggaaggcaacau

SEQ ID NO: 7086 - RNA, 19 nt, artificial
  Oligomer
auuuuccgcucguuggcug

SEQ ID NO: 7087 - RNA, 19 nt, artificial
  Oligomer
gauaacgcaucauggagcg

SEQ ID NO: 7088 - RNA, 19 nt, artificial
  Oligomer
auugaguuuuuuaacccga

SEQ ID NO: 7089 - RNA, 19 nt, artificial
  Oligomer
guuucccacuuucaaaugg

SEQ ID NO: 7090 - RNA, 19 nt, artificial
  Oligomer
acuuucaaaugggaaaacc

SEQ ID NO: 7091 - RNA, 19 nt, artificial
  Oligomer
guauugcaaacaaugacuc

SEQ ID NO: 7092 - RNA, 19 nt, artificial
  Oligomer
accugaaauuugcuggaau

SEQ ID NO: 7093 - RNA, 19 nt, artificial
  Oligomer
cagagagcuuuuugaugau

SEQ ID NO: 7094 - RNA, 19 nt, artificial
  Oligomer
cacaugcaaucuaucucau

SEQ ID NO: 7095 - RNA, 19 nt, artificial
  Oligomer
auuccagcaaauuucaggu

SEQ ID NO: 7096 - RNA, 19 nt, artificial
  Oligomer
aucaucaaaaagcucucug

SEQ ID NO: 7097 - RNA, 19 nt, artificial
  Oligomer
augagauagauugcaugug

SEQ ID NO: 7098 - RNA, 19 nt, artificial
  Oligomer
gagaauauuucacccuuca

SEQ ID NO: 7099 - RNA, 19 nt, artificial
  Oligomer
ccgaguggaaggaaauuug

SEQ ID NO: 7100 - RNA, 19 nt, artificial
  Oligomer
gacagaaacacuuuucgac

SEQ ID NO: 7101 - RNA, 19 nt, artificial
  Oligomer
ugaagggugaaauauucuc

SEQ ID NO: 7102 - RNA, 19 nt, artificial
  Oligomer
caaauuuccuuccacucgg

SEQ ID NO: 7103 - RNA, 19 nt, artificial
  Oligomer
gucgaaaaguguuucuguc

SEQ ID NO: 7104 - RNA, 19 nt, artificial
  Oligomer
ccgaggugaucauuuuaaa

SEQ ID NO: 7105 - RNA, 19 nt, artificial
  Oligomer
gugaccacaucuuuaaaau

SEQ ID NO: 7106 - RNA, 19 nt, artificial
  Oligomer
uuuaaaaugaucaccucgg

SEQ ID NO: 7107 - RNA, 19 nt, artificial
  Oligomer
auuuuaaagauguggucac

What is claimed is:

1. A method of reducing Delayed Graft Function (DGF) in a recipient of a kidney transplant from a deceased donor, comprising only between 15 minutes and 4 hours following revascularization of the transplanted kidney, intravenously administering to the recipient, a composition which comprises a double-stranded RNA compound having the structure:

```
5' (N)_x-Z 3'    (antisense strand)
3' Z'-(N')_y 5'  (sense strand)
``` wherein each N and N' is a ribonucleotide which may be unmodified or modified in its sugar residue;
wherein each of (N)x and (N')y is an oligonucleotide in which each consecutive ribonucleotide is joined to the next ribonucleotide by a covalent bond and each of x and y is an integer between 18 and 40;
wherein in each of (N)x and (N')y the ribonucleotides alternate between modified ribonucleotides and unmodified ribonucleotides, each modified ribonucleotide being a 2'-O-methyl sugar modified ribonucleotide;
wherein each of Z and Z' may be present or absent, but if present is 1-5 deoxyribonucleotides covalently attached at the 3' terminus of the oligonucleotide in which it is present;
wherein the sequence of the antisense strand comprises the sequence 5' UGAAGGGUGAAAUAUUCUC 3' (SEQ ID NO:2) and the sequence of the sense strand comprises the sequence 5' GAGAAUAUUUCACCCUUCA 3' (SEQ ID NO:1); and
wherein the composition comprises an amount of the compound effective to down-regulate expression of a p53 gene, and thereby reduce Delayed Graft Function (DGF) in the recipient.

2. The method of claim 1, wherein the composition is administered as a single, slow intravenous push.

3. The method of claim 1, wherein x=y=19.

4. The method of claim 2, wherein the ribonucleotide at the 5' terminus and the ribonucleotide at the 3' terminus of the antisense strand are 2'-O-methyl modified in their sugar residues, and the ribonucleotide at the 5' terminus and the ribonucleotide at the 3' terminus of the sense strand are unmodified in their sugar residues; and wherein both of Z and Z' are absent.

5. The method of claim 1, wherein the antisense strand and the sense strand may be phosphorylated or non-phosphorylated at their 3' terminus or their 5' terminus or both.

6. The method of claim 1, wherein the DGF is cold ischemia-associated DGF.

7. The method of claim 1, wherein the amount of the double-stranded RNA compound is between 0.1 and 50 mg/kg body weight of the recipient.

8. The method of claim 7, wherein the amount of the double-stranded RNA compound is between 0.5 and 10 mg/kg body weight of the recipient.

9. A method of protecting a recipient of a kidney transplant from a deceased donor from Delayed Graft Function (DGF) comprising only between 15 minutes and 4 hours following revascularization of the transplanted kidney intravenously administering to the recipient a composition which comprises a double-stranded RNA compound having the structure:

```
5' UGAAGGGUGAAAUAUUCUC 3'  (antisense strand;
                            SEQ ID NO: 2)
3' ACUUCCCACUUUAUAAGAG 5'  (sense strand;
                            SEQ ID NO: 1)
``` wherein each of A, C, U and G is an unmodified ribonucleotide or a 2'-O-methyl sugar modified ribonucleotide and each consecutive ribonucleotide is joined to the next ribonucleotide by a covalent bond;
wherein in the antisense strand the first, third, fifth, seventh, ninth, eleventh, thirteenth, fifteenth, seventeenth and nineteenth ribonucleotide are 2'-O-methyl sugar modified ribonucleotides;
wherein in the sense strand the second, fourth, sixth, eighth, tenth, twelfth, fourteenth, sixteenth and eighteenth ribonucleotide are 2'-O-methyl sugar modified ribonucleotides; and
wherein the composition comprises an amount of the compound effective to down-regulate expression of a p53 gene, and thereby protect the recipient from Delayed Graft Function (DGF).

10. The method of claim 9, wherein the DGF is cold ischemia-associated DGF.

11. The method of claim 9, wherein the donor died from brain or cardiac death.

12. The method of claim 9, wherein the amount of the double-stranded RNA compound is between 0.1 and 50 mg/kg body weight of the recipient.

13. The method of claim 12, wherein the amount of the double-stranded RNA compound is between 0.5 and 10 mg/kg body weight of the recipient.

14. The method of claim 1, wherein the donor died from brain or cardiac death.

15. The method of claim 1, wherein the composition is administered as a single administration.

16. The method of claim 9, wherein both the antisense strand and the sense strand are non-phosphorylated at the 3' termini and the 5' termini.

17. The method of claim 9, wherein the composition is administered as a single administration.

18. The method of claim 17, wherein the composition is administered as a single, slow intravenous push.

19. The method of claim 1, wherein the amount of the double-stranded RNA compound is 10 mg/kg body weight of the recipient.

20. The method of claim 9, wherein the amount of the double-stranded RNA compound is 10 mg/kg body weight of the recipient.

* * * * *